United States Patent 6,812,339 (POLYMORPHISMS IN KNOWN GENES ASSOCIATED WITH HUMAN DISEASE, METHODS OF DETECTION AND USES THEREOF) - sequence listing, part 45

SEQ ID NO: 14385 - DNA, 72602 bp, Human
gaaaccctatctctacaaaaaatataaaaattggctgggcatggtggcacgcacctgtagttctagccattcgggaggctgaggtgggaggattgcttgagcttgtgtggtggaggctgcagcaagctaggattgtgccactgcactccagcctgggcgacagaacaaaaccatgcaaaaacaacaacaacaaagttattcagatgccttagcctgggaaagatcatggtgcccaccgtccagctgtaattcaagtaaaaaccaaaccatgattataaagaattcccacaatgttctgatttcatccatatgtttgtttgtttgtttgtttgtttgagacagagtcccactctgtagcccaggctggagtgcagtgatgtgatctcggctcactgccacctccacctcctaggttcaagtgattatcctgcctcagcttcccaagtagctggaactataggcacatgccaccacgcccggctaatttttgtatttttagtagagacaggttttcaccatgttggccaggctggtcttgaactcttgagctcaagcaatccacctgccttggcctcccaaagtgctgggattacaagcatgagccactgcgcccagccatccatatgcttgatacccaactcttgcacgctaacaccagaagcatgcgttcagtctacctgctgggcaatccagctccagaaggtctgaatcagagctgtaggatggggttttcaggaccatagtgcacactgggctttgggtggtaggcagggagcccgtccagctctgggcaggggggtggtacagtggactatggaagctgagtcacattctaaggagagaatcaagagctccctaagtaccttgccactccaagcctcagttttcttatctgtaaaatggaggtaataatagtggctaaataaagccactattattagaagcttagaagaaacgatacagatatgtaaagtagtaacagtgtactctgttatccactccacaactatatattgagtggttactatgtgccacggagcagttcaaggccctcaagataacccgtctctactgaacaaaaccaagagctcttcacagacgtggtgtggagtggagtggctgttagcttagtagccgtgggagccatactgcctggggttgcatgactagccgggtgatcttaacctaggtacttaatatctctgtgcctcagctcttttgtgttaaataggtgagtaatggtatcaacctcataggcctgtgtgacagtgaagcgaggtaatgcacagaaggcgcttagaggagtgcgtggctcagtagtgttaggtgggggtggtacccaaaggtagggcctccccattgtctagtgtcctcagggctctccagccagcgaggctggcagcagcgcccccggctggtcccgagagaaggaagggcgtcctcctcggttcccagcggcgctcccggctcctctcctccctgcggacggggaagcctcggtaaccgctgtaactgctcggggaaaggagcgcttccctggccgggctcggcgcgcgcactgtacccggccgggatcgtcacatccagggctcaaacagccttaagaggccgacgcggttactgtctccatttcacaacgggggaaactgaggctccgggaggtcaggttcctcatcccacaccacgcagcgagggcacggcgcgacgtggggcccgcggctctgcctgtccccagcctccgcctggtggccggcagcccgccccaatcactgcggcgtgtgcgcgcctgttcccagcacgtgtgcgcgccccgagacccgccccggggagccaggagcgcggtcggggtcgtgggggcggaaaagggtggccagggcggacccgcggggcgggcaaaagggcggaccttgggccaggcccccgccccgccctccggccccgcccgccgggctgcagggggaggcggcggcggctctgggcgccgggagtcggcgggcggcgaggagcgcggagccggagctggacgccgccgccgccaccgccacctgcgcggcagtcatcaaggtagggcggccctgcgccgccggccgtgccttcccggtctgcgcgatgggggcgtcgggcgggacgtgcgcgctgcgcccccccggctgcagctcccggagagggagggatgcggggctcggagcgcgggggacctggctttcagcccctttgcgtgaccttgcacaaagcactgctcctctccaggcctcagtttccccgtcaggatagcttgctcattggtggcccccttctcgcggggttgttgggaggggccgcctcgaggtccgggctcccgacggctcgctgccctcatgagcactgtctgcaccgcccacccctcctgcccgcggtgagggaagctcactctgggcgcggccagccggtcccgacaggcccctgctgtggcccgggtgctccatgggactcttgtcgggaccctccccctcttggctgcgttacctgctgggcctcagcttcctggtacaggaaacggtggggtggggggcatccccgggtccccgccaagccggcctgggcgtgcatgtggggcatcagccggcccgccaagagggtttactcgtctggggctggaggagccctaggttggaggtggctggactcctggcggcacgactgcctggaccagccccacgtaggcacctcgatttagagagtggtataggatagctccttccccttccccacccgggccaggtgctggtgcctagctctgtgtcccagagctagtgtgtgataaggtgtgacacacactagctggtgtgacaaggggtgactggcggccacgcctggacctcagaggggtgacagtgccaaggtgctgtgtccgcgtggcattaagggatggggcagagcacaggtctgagggactgtggtcccaggctccctaggtaaagaagacctatggcatctggcccagcccctctgtaagatcccctctggaaggtcttgctgcccccttgcacactccttgtgataggaatctcactagttgtaaaccaagctggaatctgctacccagtcactgcctctcctgctggtcctgctctggacacacaaacaacctctgacccttcctccctcaccctggggcagtggtcaggtcccttaaatatgctcatctccagacccagcagccccaggcccagcagtttctcccatcagatcccagggagccaaggcaagaagagggagccgaggtgtctgccctggagcaggctgtggggcctccgctttcctggggcttgttcagaacccacctgtgcatcaggactggaatgtgtctccccagcttcctgcccctcctggggaccgtctgagaggtccggagtgaggagagccggagcccctctgcaggcctttcctgccccatggggcctcttctccacctccctgatgcctgccctgtttgagggagcagtttctaggaatcacttctcagcctcctggtctttcttgtccccttcatgacctgccctgcacccagggattttcttaacagccaaaagagggcaggaggcccctggacaggtagtgagctctttgtcatcacaggtattcaagcagaacctgggggtgagctaccttggactgaaagtctatggaattctagggctgaagtagtgcctatgaccttgccctgcggccatggtggagctgcacaggactgggagctggaccacaaatgagtgttattatcccctcgtaaaagcaggcaaagtatatgtgctggcccatgagcccagctccgacgcacaggcttaagtgctacctgggtctcctgtcatctcgacacatgtataatctgggccctgttttcctgcttgcctaattcaagcctttttggcctgatttaggagcatggcagattctggttattaaaaagtcatgctatgactttaattgctaatactttttaaatgcaccatggaatcatggaatgtctgagctgaaaggagccttcagacgtcgtctcattcaaccccctcattttacagataggcatcccctgtcgccagaggggatgtgactgggcaaaggtcacacagcaaaccagcaaccgagcccagggatcctgattccaagattggagtgcctttttttctccaaaaaaacacataacatataataaatgaaagcagtctgtatttattcctgtaaaattagcaaaaataaaaataaaaagatgaaactctgtgctggcaaggctatagggattcgcctgtggcatttaattttgcagagcaacctggcagcctgttatcatgaaaatgatcatatttgccctttgcccttagccggctactttggggactttatcctaaggaagtaactagggagagagacatatgtagtgctgttatttgtaagaagttgtcttctggccaggcacagtggctcatgcctgtaatcctagcactttaggaggccaaggtgggcggatcacctgaggtctagagtttgagaccagcctgggcaacatgatgaaatcctgtctgtactaaaaatataaaaattagctgggtgtggtggcacatgcctgtaatcccagctactcgggaggctgaggcaggagaatcacttgaacccgggaggcagaggtggcagtgagccgagattgtgccactgcactccagcctgggcgacagagcgagactccatctcaaaaaaaaaaaaaaataaaggagttgccgtctagtgaagaagtgttcagttttatctgaggcttaataaacatttcatttgacaaatacagcttaaaaaatagtggcactgaagcttacattaccggagtctggccagcatagaaacagtttaatccagaagaaagaccatgagactaaagtcagcagacatagattccagattgaagtcttcctcttccctactgtgtgaccttgggccgatccgttcccctctctggacctcactttctccatctgtgaaatgggggtagactcagcagttgctgaatttgtttgagctctgacagccaacctcttagagtgaacaaatctcagtagcaaagccgagattggaaggagattcattaaatgaatccccttagaggcaggtagctagctccccaccgaggggtttcagccttaaacctttgctatttcaaaatggccagaagctggatcgttttagaagttggtgtgtttttatcttctctgccaaatctcaggaggtccagaaaataattcagcagaatcttcttgtgttttaagtctataatccatgccttgcctccttcagaacagattggacgtgctttgcaatcacacctggtctaaagggccaggagtaggtgactttgcttctgtggtcaaactgtgcctcctgggggtctgcaggctgctatgggaaacttactaggttaaaccacatgaaacggccagtatgtgactttttttgacttacaagaaatggcaatttcatttggttcagcctaaatggaaaaagatatacaggtatttaaagagcggtgtgctccttactataattgagagattggcagggtgtggtggggacaaggaaggtgtgattatgagcttgcagaagtcaaggaggagggacatgggagcctcactttgaagaatcactaacagtaataataatagctaacattcattgagggtttaccgcctgcctaattctgtcctaagtgctttatgttcattcattccattagtcattcagccagtatttattaagcacctacattgtactagtttttttgtttgtttcttttgttttgtttttgttgttgttttttgttgttgttgttgttttctgagacagagtctcgctctgtctcccaggctgaagtgcagtggcatgatcccggctcacggcaacctccgcctctgcctcctgggttcaagtgattctcatgcctcagcctcctgagtagctgggattacaggtgcgtgccaccacaccagctagtttttgtattttcagtagagacggtgtttcgccatgttggccaggctggactcgaactcctgacctcaaatgatccgcttgtctcggcctcccaaagtgctgggattacagatgtgagccaacacacctgacctgtactaggtattttctaagtgctggggaaagggggaaggcgctgatattaaacaaaatagaccagaaagatcttcccccaaagagcttacaatcagatggggggaagacagatgaaaaacaataaataaaatagatgaataggtgataaataaaatcagtgataaatgaggtggagcaaatagaacataggaggggttagggtgtgtgagggggcagttttaactagggtgggctgggggcctcattgagaaggtgatttttaggcaaaggcttgaaggagaggggtgagtcaggctcatttctggggaaacagccattcaggtggagggaacagctggggcaaaagccctgaggcaggaccatgcctggcatgttcagagaagcacgagctgggacagagtgatggcgggagaagaggaagagaggagcaggcaggccctgggctagactgtgtaccccaccatgctcataatggaatcctgcgagtgtatgacggagctactctttttatcccgcttttccaattaagaaaacaaaaatacagaaaagttacatggcttattgaaactgtgtctcatggagaatctaggactttcagccagggtcagcggggagccatggaaggcttttgaattgggtaggaacatggccagatttgaatattggtgtgattcctgcgagattgctatggtctgaatatttatgttcctccaaagctcatatgttgaaatcttaccccataaggtgatggtattaagaggtggggcttttgagagggaattaggtcaggaaggcagagccctcataatgggattagtgttcttataaaagaggccccagagagaccctcacctcctccaccacatgaggacacagtaagaaggcgccattctatgacccaggaagtgggccctcaccagactccaaatctgctgtcttagtcttggacttccatcctcctgaactgtgagaaatacatttctattgttgataaagcacctacatttttttttttttttttgagatggagtttcgcccagccgcctaggctggagtgcagtggtgtgatcttggctcactgcagccaccgtctcccgggttcaagtgattctcccatctcagcctcctgagtagctgggattataggtatccgccatcatgcctggctaatttttttttttttttttttttttttttgagatggagtcttgctctgtcgcccagggtggagtgcagcagcacgatctcggctcactgcaagctccacctcccgggttcatgctattcccctgcctcagcctccccagtagctgggactacaggcgcccaccaccacgcccggctaattttgtttttgtgttttcagtagagacggggtttcacagtgttagccaggatggcctcaatctcctgacctcatgatctgcccccctcagcctcccaaagtgctgggattacaggcgtgagccaccgcgcctggccaaagcacccaatttatgatattttgttgtagctgcagcaacggacgaagacaggtgcagagagatggctgtagaaatagtccaggcctggagtgctgctgtgggacctgggcagtgagctcagtgctaggggagaggttggggtccaggccaggtgagcaggaggaggatgaggaggaagccaggctgaccctgggcttatatatttaacaaacacttattagcacttcttaccaccatctaatattttatatacgttaacccaatccccataacaacctatagggtacatactgtttgttattatttctcccgttttaaaatggatatattatatgtaaatgatatctcatgaagttaatttacaaagaaaatacatttttaaaattataaacacttgataatggagaatttcagaaaaaggcaggaaaacagacaaaataaattacccatatcttctcctcttctcatcccacataatcaatatgaacatttactttcagtcttttttgtactatcattcccattttatagatgacaacactgagccccagggaagttgggtagctagcccaggatcatacattcaatctatgtcatctgccaccagtgtccagggcttaatcaccttcccctgctgcctgtagtccatccctggaatgtcagagttggtgggttccattaagataccatcccccaaacctagcccctccccccgccagccacccctctcctggcatcatttcacagataggtaaagtaaggcccaataagagatggggccttgctcagcatctgtcagccagtcaggagcagataggtgaagtctcattcaaataagaaatcgggagctgagcatttgtgcagggttgatatgacagctgcttctagcctggccttgagcctggagtttgtaggggccctggcaaatggcatgaccctgcccacaggcagtgcaggggcaggcgtgtgttccctgggcccaagagtcttgtccctctagccagccctgggtgggaggtgagtttggggctttgcccacactgcaggtcccctgagagttgtctcctgtactctgactgtgcatttatttctggctctggtgccagcaaactcctggggctgcctgctgccagggatgcagccctggcttctagccccatctcagacactgagtggccttgggccagggtctctcctggcccacctgcaaaatggcatcataacggccccagccacaggatgaagtaagaagtgcaagggaagttcttgcacagggcgtggtctatggcgtgctcaataactgggcaactcctgtggctgttcctaaggctgcaccacggtgttggcccaggctggggaattgagcccactgcagacagagccccctcctgccaacctccctttcacacctggctgaccaggtagacctgcctgagaaatcagatacgagcctccagcaatggtttggagtctaagattgcggacaacaagggatgcagtggagcaaaagaacccaggcctctgaagaaggagagctgaccccgctgctgatatgctccttaggcaagtcttgacccttctttatgactcagtgtcctcatctgtaaaaggggaagaataattcctgccttagtcattgtaatgatcttcaccccagcaaccacctattgatgtttttctaatgcttggggagtgtgaatgcagacaagctagacccatcacagccgtgagggcccatggcctggcaggggcactacagttatcatagggaagcccaggagctgtggggcctccaggagggcacctaacccagcctggggtggaagtggggggtcatggaaggctccctagaggagctgatgcctgagctgggttgttagtgtgatttggagacggccagactatgaagggtagaaaaataagggaagatattgggtcagtcactccacttctctaagcgtcagtttcttcatttataaaatgaggataataaatacctgttctgcctaatgtataagcttgttgtaaggctctaaattggataaaagtaaggaggcgctttatgaactacaaaatgccaggcacctacctattcattattcattgtgatttctggagcccctaggggttagggaaatatcaggccagcatctggggctgggagaactttcagttggttttgaaagggctacaatcaaatcggacagagacagacagccgccattaaccacacaccccttgatttaagtgctctggagtatttctgtgcctgggtgtggctttgtttggtggggtccccgaaggcagccatggccccatcacagatcacagccccactctgaggatgaggaggaacaacgtcagacccaaagcactacgtccctgtagaggcctgggacctgccagggatagggatagaggacgggagcactgtggggccgccatgaagaaaccagtctgtttagagagagggccaccatgtcacggtaagagaaagagtagtatgtgtggaatgagactgtttgggtttggatatgagaaaagaatctttccctagcatgcagacatagcaaaatattcagacagacatcaagctaattatcactaggtggtagaattttgttttctttggtcttttctacatttaaaatgttttggctgggcatggtggctcctcctggtaatcccagcactttgggaagccaggagtttgagaccagcctgggcaacaaagtaagacattgcctctattaaaaaaaaaaataaaataaaataattttatacttgatagataatttatttctgtaaagattttggtgatatgtgtgcagtcattcctaaatattcagcttccaggacacccaaggatatcaaaatctgtggatattcaaatccctgatataaaatagtatagtgtttacatgtaacctacacacaccctcctgtatactttaagtcatctatagatcacttacaatgcctaacacaatgtaaatgctatgtaactagttattatactgtatatacatatttttaagacagagtcttgctgtgtcacccaggctggagtgtagtggcacaatctcagctcactgcaaactccgcctcccgggttcaagtgattcttgtgcctcagcctcccaagtagctgggatcacaggcatgcactaccacacccagctaattttttacatttttagtagagatggggtttcgctatgttggccaggctggtctcgaactcttgatctcaagtaatctgcccgcctcagcctcccaaaatactgggattacaggtgcaagccaccatgcctggcccattgtactgtatttttaaatttgtattttttaattgttgtattgttatttttccttaattttttcgaatattttccatctgaggttggttgaatctacagatgcaggacccacagatacagagggccaactatgtatgcaatacaagttataatgatatttagataataaaatactcaggccggtctgacatcagcaggctgcagggatgaagtcagcactcacagcataaggactttggtaaggcctggatgacatccccagtgctggccttcggaacagttgggagcagagtccaaggatggcttgatggagtcacactggaggagatgtctgtgggggtttctgaaggtgggaactaggactcttttcttgggacaaagacttggggttttgggtggctgcaagcacagtagcattgtgaccaaactgtccaactgtggaacctaccacatcagtagcaacagagggttggaggcagaggtgagggtcctgctgaagtttgggccgctttctgagcaagactaggacagctgagacagatccagaggggcgccaggccggggaagggcctgagccttcaaattccgtgaagctctggagatccagggtgaatgctaggcctcaatagacccttgtcccttaacgatttgtgttcttggtctttgatcccatctcacaggcgtttcagcctctttgcaagggaagtaaagaatctaagctactgcggtatttcattcaaggcagggcttatctgttgtgagatgtacccttattttagaatccattaagaaagaaaaagcaacagaaactgtaagttgcatcccagtttcagagatgttaaaatgtaaaaagctgtcttggaatcatttgacatgtggcgggtccccaattagactcttagtgtgcattcactcatggaatcttcaccatcgcattgtagctagatagtcttgtcctctttttacagataaggaggcaggagcccagagaggttgagtaaatttgcaaggtcacgcagccagcaagaggcaaagctgggctttgaacctggtctaattagattccacttctttttcctcatccaaccccacaaagaaaaggctcctgagtcctggcccttgggaagaacagaatctccacaatgccagctcagaaatgctccagtggcctggtcattaaaagcctggtactctgagtaatgggggtggggagtgtggaggagggctggggagataatgaacaggaaggagctttgagagcttgctggcagggtcactagcctcatccttgttgaaaccattgcaggagtggctcggcctgtgtggcctgccctggagaaagactgtagagatatctgccccacacagataatcctggagcctcacccagactgacccattcattcgctccctaaaaagttatctttcaatgtaattttttgactaggacctttgttcacgattgattactttctgtatgtaaagcattagagataccaagcacagcaaaacagacacaggcccgcctttgagggctcacagaccaaacgagagatggacagtaatcgtagagtcccacagaatctggaggaggagagaggagtgaagggcgtgcagagtagagaatgtgctgagtccggggtcactgcaaaaggctgcagtccagggcacagatggtgccggtcaaggaaaggaaggtatttggagatgagatggctcttttaaggaggtgaaactgagtctcagagaggccataggacttgtctgaggtcacacagcttggaagtgactctccttgtatggttttctttgttgcgggttcctttcttgagttttcctttggagatgaaaacatgatgtgaggggagccatggcctgcgaggggatggatgggatgttctaaggaaaggactttgagctgagatctgaaagatgagtagggactgagcaggcaagggtggggagggaggcacgctgcataggagaaacagccttgccaaagccctccggctggaggaaacaggactttgaagaactgaaagcaccgtgatgtgtgcagctcagatccctgggcaaggtgaggctggggaagtagaacaatggccgccgaggggtctgctcacgtttacatatttcggaaagatcaagggcaagatggttggtggctgagactaaatgaccaagtttaacagatgtttggagccaggcaccgaggctcacgcctataatcctagcactttgggagactgagacatgaggattgcttgaagccaggagttccagaccagcctggacaacatagtgagacctcatctcttaaaaaaaaaaaaaaaaaaaaaaagcaagagagagagatgatttgaaggtgggacaggaggctgggattagtgatggattggcattgggtacaagaagaaggaggccacgtgggtgcccgtgggttctggcttttccggcagtgcccttctcatggcctgacttgcagagggagtcgcgctgggggacacaagcaacatgggagcagccttcaccccactggggcctccttcccagggctggttattgtccaccattttcctcccaactgagcttagatatccaggttcacccagtgctggggtttgccagatgatgtgaaaaaaaagtcagtggcgtgagggattttagggtgttgataagagtgagctgatgtcccaggttactggggacaagaaatggccttccacaacatgcccatggaaatcacatggcccccacaccatccctggagctggtctttcagcaaaggtgttgctgagcatggtggtggagttggggcattgcttgatgcattgtgtcatcctggagaggggtctctggttgtggcttccagggccctctactcgagcctgaacctgtttttactgatccatcattggggacactggcaaagggctggtcacatgtggcaggtgacaggaggctggaggtggggagggtgcggtcaggaggggtgcttgaattagtgactttggaagcaggtggagcattttcacctaatgacagagttcactgtgcagtcaaaagaagggatggtgcaggtcaaggaaaggagggtatttggagatgagatggttcttttaaggagatgaaactgaggctcagagaggccatgggacttgtctgaggtcacgtagctcagaagtgactctccttgtatggttttctgtgttgcgggttcctttcttgagttttcctttggagatgaaaacgtgatgtgaggggagccatggcctgcgaggggatggatgggaatgcttgcaggaagacttcctggaagagggagcacttctctaagctgagccttgtagcagccggtcatacagagtggtggatagggcattactggcaaaggaaatgatgtaacccaaggactggagaggagaaaacttactaggcctatatgggatgcgatgaacgtagggtctggtttggctcagtataagaggcagagtataaggtatttgccagacgccaagggcagggaggtaggtgcagcctgccctgtcagggaggagcgttttagcactgacgcactgacgttgtttagaattgcaggcacattatgatcgtaaaatgtcagactttgaggcagttttttttgcttgctgttttgttttgttttgttttgtttgagatggagtctcactctgtcatccaggctggagtgcagtggcgtgatctcggctcactgcaacctccgcctcccaggttcaagaaattctcctgcctcagcctcttgagtagctgggattacaggcacctgccaccgcacctggctaatttttgtatttttagtagagacggggtttcaccatgttgatcaggctggtctcaaactcctgaccttgtgatctacctgcctcgacctcccaaagtgctgggattacaggcaagagccaccgcgcctggcctatttttaatttctctgttgaaaatgcacttcctgagtgtctgcgcccggccgactgctcacctccctcctgccctcatccctgccacttccccttccctgcttgcctcacatcccttcttgatatactcctgggccacaccttggctttgaatccccagctgagaagctattgaaggttttggaatagaggatgctgccatctaccagtagcccaagtggggtctcagctttagagaggtgggatctgagatgaggacagcctggaggaggcaggaaggacctggaagatggggaggatgagagataggagcaggattgcaggtcattgcttcatgagacccaggacccatgtccacagctgcccaccaacacgccaggcccaggccagcacaatgctgggcagcagggtctccgcgtcctgcagggtcactgctgtggctggtaggcagaggcagaatcctcatgctctagcggtcccagatctcagacactcaagtaggaccttccagagcctagggaagggtttcttcccagtccgcagatgtcagcgagactttaccggcactcaaacagcagcccaagagctggtttgattcgttccattttacagatgaggaaactgaggcttcagagtgaacccaaccaagaggcacagtaaagtaaaaggaccagtaaagtaaaaggaccggtaaagagctagactgtgaccacttttagcagccatttgtagcatcaaggcctagagatttgcattctctccaggatctgccactgaccagccaggtgaccctggacaagtcacatcccttctcaggttcttgtttcctcacctgcaaagtgaagggtagactagatcatttctgccatcctttgagcttaaaaattatctccgactctcttcatcttctatcccaattgcctccaaagtgatctatgcaagatgcacattggggtgcaggaaaaaatatctaaacaaatagaacaaagaattcagctttagtcacatttgccaggtggagacacactcgccagctggggtgtcaggcagcctcatgtggtccaggagtctcctgtctcatgtggtccaggagtctccagagagaaggggaaacactctgagaaagggtaatgaggactcccttactctttagtctgtttttggcaagttatcccaattaattaacctggtttattaatccaggttaatccagactaattaatccagattggatttacaaattatattcaccactctaagctaactagcgcttacagaatggacacgtggtttttaaagattcgtactgaaaaattgtgacttgttagcagtgcttacttactatgctaataatgctagtacatgaagacaagggaatggaagaggttgagtgctggcctgtaatcccagtactttgggaggccaaggcgagaggatcacttgaggctaggagtttgatacaagcctgggcaacatagcaaatccccgcctcaaggaaaagtttaataattagccgggcatggtggctcatgcctgtggtcccagctactcaggaggctgaggcaggaggattgcttgagtccaggagttggaggctacaatgagctatgatggcaccactgcactccagcctaggcgacagagcgagactctgtctctaaaaaaatgtttttaataaaaataaatttaaaaaagaaaaaaagtgagagaattaacactggggtttctattgcagtcacttcatcagctacaagacccaggacaaaaacagtgacaagctaataagtctgacaagtttgtcagctcaagtttgtttgtttgtttatgttaggggacactttgaaatagatatttacagtcactctggttagtgatgaatctcactctgtgtatacgttttgtcttgcgaggttgatgatgattacttgtatataatataagataatggggtgtgagcacagtttgttttttttttttcttgtggaaggagtgaatgatcaaaaaagtttggagatcacctgaggtcaggagttcgagaccagccaggccaacatggtgaaaccccatcactattaaaaatacaaaaaaatttgccgggtgtggtggcacatgcctgtaatcccagtttctctggagactgaagcaggagaatcgcttgaatctgggacacagaggttgtggtgagccaagattgtgccactgcactccagcctgggtctccagcagagccagactctgtctcaaaaaaaaaaaaaaaaaaaaaaacaaagtttggagcccattgctctaacctcctggtcttttccttgctcctgctacctctaacacgccaccacgtttgtgatcaagcgttgctccagtagggatttccctatttttctacccattcccaaggggagagaccccatgggaatacctccatccacagagcccagcacaggggctatctccagctggggacttggaaaatgtgggtggagtgaatgtgctccaggtttcccctcacatcgtgggggctgctgatgctctgccggcctttctagcagaaaagacctaaggtctgccatcattcccagcctaaagcactctctggagaaacacagttcacctttcaaaggtgtgagtccaggagagcctagataaggccaatgacccttgagctcacaattataaggcctttctttcctaaccatctttggaatttgtccctccacaaacgagtttccactattacttagagcaacacagataaggaacaaaaatgtttggtactgtatccaggtacaggaagacaggactctgttctgtgttttagcgtactcttttggactgggaggctggagacctggatcttgttcctggttctgccctgtgtgggtggcctttggcgtgctgactccatttcctctttctgtaccccacgatctcttggggtctggctagtgcttttgttctgagatgtgacatctgggatccttttggggacctgctctgctgaggagttctcagcccccatctgcagagttcgagtataacctggaagatggggagagcttggagcacatgggcaaccaaaatggggaggacatgggaaaccaagtcacacaagaaacccccaccccccagtggagccatcccatggtcctgagttaagaggtcttcaatctctggaaggctgtcaaggggcagaaacaatggatgtggctggcggggctccaggaacaggtagggcagtggggaaaattgtagatttctgttcagtagatgcgaggaagtccactggttgagcacatcttcccccagcaggggtgagctccccatcactagactggtacgagccaaaaccatcagactgtttacgtggggtgctggggaaagaagggcagaattctggggtattgtatttggtgcttacccctagatgtaatatgatttgggagagaattagtgggtctggctaaaaactgaagaattagagctttagattctaaatcaacactcatgggttgataaggggcacaaggctttctctgctttcattcggttcagagggttttggtgcctcccagcacaggtgacacccctcaccccccgccgaatgtttagatcttttgatattgccgctttgaggaaaaataaaggaccatgaacactttgtgcttctagtttaatctgtaagccctgctcaaagcccatattcatttttattaaatgttcatttcaatccatgaatacaggtaaatagcttaggacagtgcctggctcacagtgagtactcaataaaggttaccattatttacttattttgagtttagttatttaacaaatacttactttgagtttaccatgtgccaggctgggttctaagtgcttgacagatattaactcatttatggttatcatccccattttatggatgagaaaacccaaggccaagagaggtagataactggcccaatgtctcccagctggtgtgtggcagggctgatgtctgagcccggcaggcaggttccctaccatgtcagtagccactgtgctgctgcctctccatgcgattgtgttgtgtaataaataaaccagcccctctgcatccattcttcctcagagcctccctacagcctctggaaggtgacaggcagggatgcccatgcccatttaatgggttgagacactggagcccagagaggggctttcacagcatcgcacagcaaaagggggcagagcctactggagccgggtcactgggcttggaatatctatgtgccctccctgcacagagcagggctccctgctgaagcccagtgggagttggtgctaattagggggtccctggtccctcaaggggcccttccttcaccaggaggagggaggttggtgggaagagccacgactctgccaggggcctggggaaatatcgtccaggcatgtcctgaagcagggaggctcctggtgtctggggaaatagcaaggcctccccaccctaccgagcccctctgctggggccctggcagagatggccctgaatagccaggagtgaaaggggaagcagacagggagggccatcccgcaccccaccccctgcttttgaagtcacatcagggaccaactctaaggtcaagggtcaggaagggctaaaagaataggagctctgtggaaatcaacatggaagcagagatgtagctgccagggagttcaggaaagctgtgggctgatacctaagtgctgtcatttctcttttctttattatttttttaatgatggtgatatatacatagcaaagtttacgattttaaccatttttaagtatacaattccgtggcatgacgtacattcccattgtgcagccatctgtattagtccactctcacactgctataatgacatacctgagactgggtaatttataaaggaaagaggtttaattgactcacagttccacatggctggggagcctcaggaaacttacaatcatgacggaaggtgaaggggaagctggcaccttcttcacagggctgcaggagggagataactcgcaggggaaactgccacttttcaaccatcagatctcatgagaactcccttagtaataccagaacagcctgggggaaaccgcctccatgatccaatcacctctcaccaggcccctccctccacacttggggattacaattcaagatgagatttgggtggggacacagagccaaaccatatcaccatcactgccaagatttttacattttgatttcacagtagcctactctattatttaatgtttttgtttacatgtgtcaatgaagagcttatgttcagactgaaatatatttgacaaaacaggaatatacatgtaggagactaacacctggctgagcacttgccaagcactgctctgaggcactttatatgaatgaacatctcctctataaggtaggtgctatcatggaccccagcttacagcttaggaaactgaggcacagagaggtttaggaaagctactcaaatgcttgccttggcccactggttgctaccgtttattgagaactttaccatgggccagggctacacgctctttggttttttttttttgttttttgttttggcggtggggggtgggcgggggaacagagcttcactctcgttgcccaggctggagtgcaatggcgcaatctcggctcacagcaacctccacctcccaggttcaagcaattctccctcccgagtagctgggattacaggcatgcgccaccacgcccggctaattttgtatttttagtaaagacggggtttctccatgttggtcaggctagtctcgaactcccgatctcaggtgatctgcccgcctcagcctcccaaagtgctgagattacaggcgtgagccaccacacccagaccaaaggctacacgctcttaagctccttgctcatctcacagcaacctgacgatgtggtatcaagacttagagaagggaagtgagtctggatttggatccaggtttctctgactctgaagcccgtatcttaagcacgtgtactgggctgcgaagctgttatgggacagcagacgcaataggtggattttgttccggctgtggagcaccatgagaaggaggacgaggaggattgggacgcccagttccggagtgctggcctcagagcatgcaatttatatgttgagaagagacttaagaaagcaagccaaggagcagagccgcagtggccaccgagttggggggtggttgagtgctcatggagcccgtggattttggacaggagttcctgctgcttattaatcgtgtaacctcagaaaactgacgccgctgctctgcagagtgccccggccacactcacgaagtggagataatcctccgcgcccccagatggttgtgaggggtaaactgagcgatagttgtgaatcatagagctgggctgtagagcagcgattctcaaagagtggcccctgggccagcggcttcctagtcaccgggaacttggtggaagtgcagactctcagctctcacccacgctgccgaatcagaaactctagggtggggcccaacaatcggagtttgtttgtttgtttgttttttgtagagacagaatcactgtgttgcccaggctagtctggaactcctggccctaagcgatcctcccacctcggcctcctaaagtgctgggttacaagcgtgagccaccacctgggtttgtttttttccagccctccaggtgactctgagcaccctcagatgctctgctgtgacacagcgggcaaacacatgtaaatgtgatgctgtcacctgtcctcacagccagtcttgcgggcagaagtgcctttcccacaggggcactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcaggtgagagagtagcggaaaagaacttcccatccacttcccgctgtggggtcgagctcagaagtggggtgtggggctgagcttggaagtgaggcatggggtcgatctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtgggactgagctcggaagtagggcgtggggctgagctcagaagtggggtgggggtgccgagctcagaagtggggtgtggggcttccagcatctgcaggagcaggcaggccttcagtcatatctggggactcttgtcccagggcagtcacacccttttcctcctgagtccaagcacggaaggcctcagaattctctccctcctcctcatggggttccgcaacccctccagcccactggagctggacatgaaatgaaacccacttatttcttccttcgataccagcccaaagttgaggaaagaaatcgtttcccaggctcaatgtcctgacttcctaattgcaggggttaagtctatttcggctctgaccatgtcacacccccagttacacactttgatgcctccccactgtctcaggtgccccctcctcagcactgcgcccccagcacctctcccagcggcagccccattgctggcctgcatttgctcagacccagcctccccacccccgcgctgcaagctcctggctccatctccgcacaccacagacaggcatgacctagcacagcgccttccaccccatgcctccccttccctcctctgctgggcttgctctacttggccttgaaagctcagctcagtcgtatcctcccgggggccctccctgacttcccagatttccatctccctgctgcaacttgcagcgctggctttagccctgatgaccctgaattgagcttgctggttacatgggggcctcccccatcctctgagctcccccataagtgacgctgtctgggtctgcccatgcatctcccctacagtgcccagcatggcatcaggctcagagtgggcaccaatgatgttggctgaactgactctgggccccaggtccctgaggcaggcagagtgagggctgatttgtgggtccacgctgagaacagaatgcaggacccctggttggatgcccaccccaggaccagagttacagagcttcagccctgcctcgggctgactgtgggacgctaagcaaggcgcgcttcctctctgagcctcagtgtccctctctgtccaaagacaggtctgaaagctctgtgccagaaagcggacagtgagcagggagtggagctgccagattttcagcctcctggaggtgtcttggaaaatccccagtgatccttgtcgctcgaaactcccagataaggagattgtggggcaataaacctgtgtggagttttggtcagggcttgatttgggggattaaacagaaagaagctctgctctgtctccagaaggtccaggcaggacaagaccttctcaggacagctgatggctggacagctctgtcgcccttgtggtcctgtgtgtgtctggtgtgtgcaagctgcagcaccctccacagaccgtcctaacaggtgggcagggcagggctgttactattatatggatagaaactcagaaagcgggagaggggacgagatttgcccaaggtgacggagcgaattggtgtcagaattaggattctcggccaggctcagtggctcacacctgtaatctcagcactttgggaggccaaggtgggcagatacctgaggtcaggagttcaagatcagcttggctaacatggtgaagcccctttgctctactaaaaatacaaaaattagccaggcgtggtggtgcacacctgtaatcccagctacttgggaggctgaggcaggagaatcacttgaaccccagaggcagaggttgcagtgagccaagatcacgccattgcactccagcctgggtgacagagcgagactctgtttcaaaaaaacaacaacaataaaagaattaggattctccagcctgaccagcacaactgctatgacagtgatgggcccagccccttggctcctaccacctcaaggaggggttcagaagaagctgctggtgtgagtgaaagctcaagctgggagtcaggttggcctccccctgggtacccacagggctgtaggtgggcacagcagaaggggagaaccatctaaggttgacagtcctatgggtgtgttggtgggggaggaaggaagagaaggaaaaaacacagtgggcaggaaaggagacgaggggcgcttccatgggctgagctcctactttgtgccagacacatgcaaggtcttttacatacattatttcatttaatcttctagattctatgagaaaaatatgaggatactctaatgctacggcacagagacaaataggggtccagggcttgaacttggtgccttctttttccctgcctttggctacctccccaaatgtcaggatgggacctcatgggatggagagactgctcagtctgagagctggggaggctccttggaggtggttctgttggagctgggccaggaaggtggggtgacaggaaggggcattctaagagccctgctaagagccacccagcgacttacctgagctggcttagttctaggcagagggaaggggcatgagcaaagacagattatctgggaaaatgatgcttttttattttctttttgcttctccccttctcttttgaaaagcacgatgctttgaggggagagcagacagaccagtttgtctcagagaacaggtctgtggagatgagaaggaggtcaaagactcagggggaacgtagggacctcaaaacccaagtccagcagaggactttatcctgaggacagaggggacccggggtgcattttaagggaaagtgcagggccagagttgggggtggaatatgcgaggcctgagtccccaagagagaaggctgctgaggccttggcatggcctgggagaggggtagagagcaggtgggggccgtgggggcagggctggggaggaggcagggcaggaggaggtggcccgcccagggacggtggctctgggcagtgtcagatgtggggaggaggcactccctcaggcctaatctcatcaggaagaaagaggccttgtcttggtttgctctctgactcaatctgtacttcctgtgggcctgcagagatgcatctgtgctggaccagaaggatgggcggcgcgggggcggggaaggcggaaacctgaggacgggactctttgcatttgctgtttgcatttgccggctgcagacggcttctgcctcgctggtgatggtcaagccccaaaggagggtccctggatggctgcgctctgcttccctgcctgggctgtgctgatggagaaaaagcaaagggcttcttcccccacccctccaccccgtcccaggtccctcagcactagggcagggtggggccttctggcctccacctaggagaacccagcccggagagatgcacaaatgcactctcttggattctttttgatcagtaggaattgtcagctagccttctgcatgtgtgtgtctgtttccccatcatcatggtttgcaccaggggttggaactctcacgagccacttggcccctgggaggctgcttcatgctttctggtttgggatttttacttagatacccaaaatgctggcctcccagcatatacctgttgtgtgttaaatcacatctcagtgtcttgtacacattgggaccacaacaatcttactagccaacgtcttttgaacactaagtatgcaccaagcatcactctgcatgctgtgtgtatcaccttatgtaagtgtccaggaacccctgcgagagagtgtggacctgtgactgaacagcctggcttcagattccagcccagccactaactagctatgtgatcttaggcaagttatataacctctctgtgccctgtttccttatcttaaaaatggggctatgacagtacttgcatgagggttgagttggtatgtggaacatacttaacacctagtcagtaatataggcgttagctagtatgtgtatttgtagtgcctgattttcctggtgaggaaatagacacattaagtaacttgcccagagtggcagataggaaatgatagggtggtgctgtccatcagaactttgttcagagatgggcatgttgtttaattacactgttcattgggtgttgcttgtatggtttcatctgtgattatgaagcacatgtggcttttgagctcttgaaatgttgctagtgtgactaaggagctggattttacactttatttaattttaactttaatttagaagccttgtgggactagaggttctgtgttggacagggccgtttagagccaagattagacccctgacagtcaagctccggggcctgggccacctctgtgctctcctgcttctttcttgcttaaatcttttacaatggaaatttaaagacacatacaaaattaaaggaaagattcaaatgaatcctcttgtaccctcacccactttcagtagccatcagcagcctgtttcatctctacgcactcattccctcctcctctgtccaacaaccgcaagttattttaagataaatcccagatgttatatcatttcatctgtgaatattaggcatccgtctctaaaagataaagactcttgtctaatataagcacagtattattaccacacctaatgacaacaattctttaatactgtcaggtgcccactcagctttccctgattgcttcctgatgcctttttgcaattggtttgtgtgaatccggatccacacaggatccacacattgcacttcttgctgtgcctctgatctcttaagtctcttctgaactgtaatgacccttgtccctttttccttgtcatcttaaagaaaccggatcttttaaaaaatatatgtatatttcattgtactaaaatacacataacatagtatttgccatctaaatcattcttaagtgtacagttcagtggtattaagtacgctcatactgccgtgcagccatcaccaccatccatctctagaactctttatcttgcaaaactgaaactctatatccattaaacaataacttttcattcctccctaccctcagcccctggcagccaccattctactttctgtccctgtgattttgcctactcaaagtaactcatataagtggaatcatgcgctgtctttttgtaactggcttgtttcacttagcataatgccctcaaagttcatccatgttacagcatgtctcaagactttcttcctttttcttttctttcttttttttttttttttgagacaggatcttgctttatcacccagactggagtacagtggtataatcatagcttactgcagcctctaactcctgagctcaagtgatcctcccaccttgacctcccgagtagctgggactacaggtgtgtgccaccatgcccagctaattttttttttatttctagcagagatgaggtcttgctgtgtcacccaggctggtcttgaactccagaacccaagcgatccacctcatcctcccaaagtagagttttcttccttttgaaggttgaatattattccatggtttgaatataccacattttactgatccgttcatctgtgaacggacacttgggttgattccacatttaagctattgggaataatgctgctatgaacatgagtgtgcaaatatctcttctagaccctgctttcatttctttaagggtgtatattccagaagtggagttgctgaatcgtatgatcgttctatttttaaatttttgatgaactgccgtactatctttcatagcaactaaacccttttgcattcctaccaacagtgcactaaatcagattgtttcaaatcaaattgtttgcttgcttgttgttgagttgtcagagttctttatatattctcaacattaacaccttatcatatggatttgcaaatatttcctctcattccatatgttgccttttcactctgttgctagtatccttaaatacacacaagtttttaatttccatgaatacaatttgtctattttttttcttttgttgcctgttcctggtatcataaccaaggaatcattgccaagcccaatgttgtgaagattttgctcttcgttttcttctaaggttttttatagatttagctcttctatttaggtctttgttgcattttgagttaatgttagaaaccagaaaacttagcatgtaggatgtcctgtgtttttttcctgattgtatctgtgtggctgttaacatgtttctccatactctgtgtgcacagttacatacaaagactcggtcaacagtgggtttcattttttggcaaggccactttataagtagtgtttcctgttgcttcatgttagcagcacataatgtctggttatctcttttagtgatgctaagattgggcagtgggttcaggtattgccaacccatccattacaccactgagtctcaaacttgaacctggggggctggttaaagcagagtggtgagccccacccccagaatacctgattcagtaggtctggggaaggaggcttgagaatttgcaaataaaaagttccctagtgatatggttaatgggggactgcactttgagaactactgcatcacatccattatgtgtttctgttatccttgctcctaacatgcgctggaatcacatgcactggaagcttaagcagtgctggcatctgggtcccccacccagtaatctgatttaagtgattctaatgtgcaaagttgcaagccactgccctgcatgttagcagtccctcgaggtcacaccatctcatctctttctgctcttggtcatttccctgagaggtatgaacatgtggagagcagtgactgaattattcatctctgacccctccgagccctgctcctgacacggcttggcgcagaataagcaccaagtcaatatcagatgaagattggagattgaatgaaatcctcttcacctctctctataaagcttcctggattattctgctttgaaatttctattctatggttcggtatgttgggctctttaagaaatggattctagagcctcctctctcgcagacaacttgacaaagtcagggctaccaggaatttacaatagaattgttacgtgtaagccaggcacggtggctcacgcctgtcatcccagcactttgagaggctgaggtgtgaggatcgcctgaggccaggtgttcaagaccagcctggcaacagagtgaaaccctgtctttacaaaaaaattagccaagcacggtggtacatgcttgttcttagctatgcaggaggctgaagccagaggattgcgcaagcccaggaggttgaggctgcagagagcactgatcacgcctctgcactccagcctgggtagcaaagtgaggccctatctcaaaaaaaaaagaattgttacacctagaccctggtggtggtggtagtggtgggagagtgaccaacttatccctgtttgcctaagtaagacttcccccagtttagcgctgtaagtcctgcctccctggaacccctccacaatccgaggcaaaccaagacagttagttgccctacttctgtggagagcggcaaggaccctttttgctttgaaggagggaggaaaaattaccctgtggggtgagactgttaggtcctagcacactggatcccactgtatcacttcagaccttgttgctggccggtgcaaggcaaaagttaagacacctcgtgccaagaggtggtggtttaaaccagggtctggccttagattcacagagcccagttgtgataaaacccttacagaggagaagtagctgagccttgtatttttttcttcctgcctggtgagaaaggaagatgctgtgggaaatggttacccagaggcctaggttggcagcagggtggccttatcctccatgggctttgatttcagagccagatatcccactcgcaatgggtggatcagagaccccataaggattctggatgactgaaaagagctttcccagcaagtttagggccaaggccaggatcaagataaactgtgatggataatagtgggtcagggattggagtccaggtgagggacccacccatgatgagacgtgtattgtgtgaattctcagcctttgtagagcaccttcacatagagcgttctttatcctgattaacagtaacctcttttcggtttttgaaataactgggtaacttgtggttctaatcttccctaactgtggctgtgacataagtgtggtggttcagaccctctcaccaggcacttacaggtggcagctcactgtgcccacaagtcaaattttaagagagagaacagataaaacttcaaatattatatgtgaaaccacaaatttacgaaggggcactggtagccagcaatgcctacccatcctgttcaaagaccaaatcaggtcatttcattctttccttaaagccacaaacagtacaattaatgaataatctattataatggtttgcaccacgcccagtttgggttcagtttcagccaccctgcagctaacccttgtcctgcaatgagtttagggctgggtaaagaagaggggcctttggaacaggcaggaaactctctctgtctctttctctctctctctctctctctctctctctctctcacacacacacatacacacacacacacacaccccgcatgtatgtcaagaaaggagcatattgcatagcaggaagaggggtctctcaactagtcctcagactacttcccacctgcactgctcatcataacatgacttcagtctagtcacttcccttgcaccccagttttcccatcatcaaatgggggaaaataatccccacctaccttgcaggagagttgtgagccactgtcaggtgttaagaaataaactcaaggccgggcacaatggcttacgcctgtaatctcagcacttagggaggccaaggtaggcggatcacctgaggtcaggagtttgtgaccagcctgggcaacttggcaaaaccctgtctctactaaaaatacaaaaattagtggggcacagtggcatgcgcctgttatcccagctactctggaggctgaggcaggagaatcgcttgaacccaggaggcagaggttgcagtgagctgagatagcaccactgcacactccagcctgggcaacagagcgagactccgtctcaaagaaaaaaaaagaaataaactcagtgcgatgcaaaacccagagatgactacatcctttctgggagttgggaattcacaggccccggagcctaatcccatggcatcaggcccaccaagcctgcatgggatcacagcagcagaatggatgccacctcccgccttgtgcccagcaggctgtcccagagtgccacacctgagaatgcctgttgtggctttgatgtgggcccagccagatggaatggggcaggataagatgagtggcctgggatagacctggctcgaatcggctgttctggcccagcctgtaggcgaagggcccgctacagtactcacttgtgggcaagtgcctgcttgtagggaaaatgaactcctgttctctgaattactgagtcattaaagtcatgcatgcacggatacacgcatgcgctcatgcatgtgtatatacacagcctcagttaaacatccaaagggatgcacacgtgcatgcacacccacaaaacgacacaggcgctcatgaacttcctgatgaatgcagttcttgtgcacacacagtacgcacacaggccagcacgcatgcacaagcttcacccatgcatatacacatacacttccatgccacatacaaagggagaggtagctggccttgctagcggctgccccaccccctacttgtgaagtttcccttcatgacagcaggtctggaagaatcttagcagtgcaaataagagttagggtggggagaggattgggggacggacagaagggcactgatgttcacgctcttttgctgtcagctggcttcatccgtggggaagtggggagcctttccagagggttctagctagcttcctgggcctcattttccttctctgtagagtggaagtgatcatgatcatgacagttcctcttagggacagaggtgagatccagggctgtgatgggtctgaaagagctattgtcatcatgggtattgtctgtgaggacctggagctgcaggctcaaaagctgcaggcttgagacagctgagtgcagcccccaggcctgctgttcactagctgtgtgacccggttactggcctgaacacctacatctgaacgggggagcaaggtagcacccacttgctctattcatgcatggaaagcatttggaatggcgcctggcagcttgtaagcactcaaaaaccatgacttcttattgccacagaggtgactgtgagctccaggggaggtgttgcccaggcctctcacggcctcctcactcctcctggatggagagtggctctcaggagttgggccagaccccaggtaccccctacaggtgcacagacaggctgtggagggagacagctcagagggtccggaaggggccagggctgttgttaatgtaagctcatgtcgatttcagcgactaccccaggcccgccacatgcactcaggcaccacatttggttgatcccacctccttggtatttcagtaacatcctctccccaccatcccgtccacttcactgccctactccagcccgggtgaccattgcctcttacctgctctatcctttcctctgctcaggaatcagaggaaaacctgaaaattaaatctggtcctctatctcccctgctttatttattagaattattattaattatttttgagacagattatcactctgttccctaggatggagtgcagtggtgcgatcttggctcgctgcaacctccgcattcccggttcaagtgattctcctgcctcagcctccagagtggctgggactacaggcgcgcgccaccacacccggctaatttttgtattttcagtagagacggggtttcaccatgttggccaggctggtctcgaactcctgacctcaagtgatccccccacctcagcctcccaaagtgctgggattacaggtgtgagccaccgtgcccagcttctcccctcctttaatttctccagtagctccccactgccctcagagtccgggtatctgagatgatctgggtcctgcctcctcctctgtggccacaccaagcacaggcagccacttgccatctccatgggccggacttgcataggctgtatgaatcaggatgggtcgctgtcctccatgacaaataaccccttatctcatggttcactctacaagtgtatttctctgttgcactgtatgtcagtagaagaaagtgctctgctacacatggttcctgagggaccaactaccttatagatgcaccatctgaaacatgcacccttctcatccctttggccaaggacgagagtcctagagggtcacaggcaggtctcatgtgctttggcctggaagtgacacacatcactgcctcccatgatccactggctaacgggtcataggaggcagtgatgtgtgctatggctgcctgactggaaggggcctggacatgaggggagcaatgggacgtctggtgagcatcaccagctgccacagacaggtgcactcccgccacccccagcagttgctcaaggtgagggaggagtgggggggcctggagcggagcctgctgatttgctccttgctttcccacccgagcccaggcccaaggtggctcctccactgccaccaagttgccaagaccctagggaggtcatttgtccttgttgtttctttccaaggggacccccagtacccatttctctcaaaactcactatagagaaaagatgtgctgctccttagcaacttgtggcttttatcttatagacaccaaataaatccctttctgattctcttttccttgttgaattggccactaggaagctcagacccaaatctgaggtctacctcctctgtgtggtggacctggccgcacacctagcttaactcctcctgcgtttcaggtgatctctttttacctgcattttccttgtgtccctattttttctcttgtagctttttcatttccttctatcttgtgttctatttttgtgagtcttcttaaatcctttctggaatcacatgggcattaattagtcagtccatccctacattctgtgcagcttcctgtagctctggcaaatgcagccagggtttagggcaaagctcccgaaaggagagttggaatttctgagctttatgggatacacaagcccctgcaagactgacgtgctacctggtgctgtctaaagggcttgcctcaggggtcaggcccttatcgctatgacttgcctgaggtcacacagtgtaatctcgttctgaggaattgagcacagagaagagcctcatgggtcagccgtgtgggctgggtgagcatcttctttatcttgaccagcgtaggcccagccaaacctgccttcccctaagtggggaaggtgggggcccaagggggatagacactgtgctggacactcctggagcagagccttctctgaggaagctccaagccagcagagaaaatgagaactgaccctgaaccccaaatcagggtagacagtgtcaagggctaaaggcaaggggagaggtggctgtcagggaacagaggagagcgagatctctgctacttgggatatcaaggaggactctctggaggaagtggcttgggagctagggaaggggcggatttggatttgtggagatgggaacaggaggtgggggcatgggaatggcaagccaagcagaaggagagggacgggcaaagagccagagggctggagatgcaagagcaggtgctggggaagctggaaggtgccgtttagatgagctagaagaaaagaatcttggaatatggaatgagacccagccagaggccttgaatgccaagccaaaggatttggccttgatcctgtagggcagcaatgaatgggcagcatcagagggtgatgtgaggccaggggcagtggctcacgcctttaatcccaacctttgagaggcagctacaggagaattgcttgagatcaggaggttgagaccagcctgggcaacatggcaagaaaaaaaatttttttaattagccaggtatggtggcatgtacctgtagtcctagctacttggaaggctgaggcaggaggatccttgaggtcaggagtttgaggctgcagcgagctatgatcacaccactgcactccagcctgggtgacagagcgagatccttcctcaaaaataataataaataaagggtgatatgaggtgggggtggggtggtgagggcttggtattcagaagggtccgtctggccaagaggaggccccctggtattatgggtatgggtttggccatgaaagaggcctagaccctctcacaggccacttgtgatctggctctcctcgcccctctggcttgtattctcttcattcacgttacccaatatacatggtgtgtgtgtgtgtgtgtgtgtgttttcttctttttaatttctctttgataatcttactaaaccacatgtggttcccccaaactgttctatctgcctaagacaccttcccccagctctccctcatcctgcctacatgaccaactcctactcatcctccaagtcactgtttagttgtcacttcctttgagaagccctccctgactgtcatgtgcgaatctctgttattacccatagtacagtcggtcccagtggcccagactctcctagtagcctcacccagaggactcttcactcctgtaaaggctgggctcaggcctactgtttccaaactccctggtacctggcacagggcctagacacacagtgatgctcggtaaatattgagtgaacaaatataaggctggacgaggagcaaagcaagctgaagatgcccagatgatactagtggctgtgattgccactgttgatcaagtatctgccatgcaccaaggggtctaaatacatcatctaacttaatccttatgacaaggctatgaggcagatacttttttcaatctctctctcttttattttttttttagagacagggtctcactgtgttgcccaggctacatttgaactcctgggctcaatcagtcctcctgccttggcctcccaaaatgctgggattacaggcatgagctgccatgcctagctgagatggatacttgtgttacctcattttacagatggagaaactgagactccagaggttaagtcacttgccatccagctgataagagacagagctgggattgaaacccaggcaggctggctccagacagcacattggtacctacttagtcgggctgagggtactgggctgtctggtgaaacagcagatgggggtcaatgtggtggattctctctatggttcttctgccttgttatattcacactcaaagggatgaaaagccttaacacatcagcaagcaggtcagtaatagctatgcttcatcccatcttatcttaccaggtctacagaagtaactgtaattagagtcttttcacttgtttgcccttcacagtgcatcaccgtccacgttgaactgaccactgtcctgctcgtaccctcttatgtactcttaagatgagagctctgtgtgtcccatgatcagggcagtgagcctcataccctttgtcccatttgtctcctgcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccaggtaaggacacccccaggcccaaacagctctctggaggcagggcaggacagagggaaagtggaaagagcctgggtttctagaaagtcctagccctgcccattactagctgtgtgaccttgagtaagtcatttcatctctttgagccttggtttcctcactgggaaaaatacacctgtcctgaattttagcctctagcagttggcttagctactcgtagcacctctcctcttctctgcaatataattctgcgaatttatttcctcctgaataaaatataattttttaatgctttactgggattacaggaaattgggaaagtctccaaagccaccttccccaccaaaaaaagggaaacaaacattgagtcaaaactagctaggagaggcaaacagtaagcaagcaggaagaacaggcttttgtccttagtgcaagtgttgctagcgtaggttggaccatataaaattgtggatattcaactggtttgaccccaaaaaagcaacattttcacatagatcaacctaatagtagttccattcaggatgccaaccctgagtctctaccttaaggcagaacacctgaaggggctagagggatcccaggttagtagtgccactggctcacagcagaaactgacatgaagcctctccagaggaaagcatccacaatgtggacaggatccccacagattaaacatagagaaatatgaatccacaaagatcacaaagcatgtacaccaccatgagtgagagtcagctgaaacacaaatagcagacttagacccccagaggacttcagaagttaaaagatcacgcagattagaatctcatagaccaggtttcctgaacacaatgcaattgagttagaaatcaataacaaaagataaatcttaaattcccattcatttggaaacttaaaaactatttctaaataatttataggccataaacaaaatcaaaatggaaatttaaaaatccttggaattgataaaatgaaatatatcacaaaacttacgagatgtagggaaagtggggcttcaagggaaatctatagcactaatgcttatattagaaaagaaggaagcctaaaaattaatgattaaacattccatctaagaagttagagccgggtacagtggctcacacctgtaatcccagcactttggaaggccaaggccagaggattacttaagcccaagagtttgagaccagcctgggcaacatggtgaaaccccatctgtacaaaaaatacaaaaattaactgggcatgagggcatttgcctgtggtcctagctacttaggaggctgaggtcagattacctgagcccagggaagttgtgagccatgctttcaacactgtactccagcctgggcaacagagtgagaccctgtctcaaaaaaaaaaaaaaaaaaattcaaacaaagagcagcagaataaacccaaagaaagtttgaggaaggagataataaaaagcaaaaatcaatgaaagagaatataaggatacattagagaagataaaagggccaaaagtttgtttttagaaaagggtgatagacaagcccctgcagagactggccaacaataaaagagaaagggtacaaaaagcatcaggaatgagaaaaacaatatcacagcagagctttgaaatctaataagaactaatacaagcaactgtatgccaataaatttgagaacattaacaatatgggcaaactccttaaaaaatataacttgtcaatactgatttatgtagaaatagaaagcctgaatagttctttaaaggaatagtcctttatgtactttaaaaattgaacaataggccaggcgtggtggctcatgcctttaatcccagcacattgggaggctgaggtgggtggatcatgaggtcaggagttcgagaccagcctaaccaacatggtgaaaccccgtctctactaaaaatacaaaaattagccaggcacagtggcgggcacctgtaatcccagctactcgggaggctgaggcaggagaattgcttgaacgcaggaggcagaggttgcagtgagctgagatcatgccactgcactctagcctgggtgacagagccagactccatctcaaaaaaaaaaaaaaaaaaaaaattgagcaataaaaatttcccttaaagaaaatagcaaaaggaaaggcgagctatagagtggaaaaggatataataaacatgacaaaagactcatttcttgaatgtataaaatgtaccgaaaaatccacaaaacactgaaccagcacttcatagcaaagaaaatccaaatggctaataagcatttgaaaaactactcaacctcattagtaaaccagtgcaataccactacacatcagattgtcaaaaatgtctaacactagtaaatgacagcaagtatacagagttgtgtaaacgatcagacacttctgatgggagtgtaaactggcacacctgttttggaaagaagaagaaaatgcatatacctgtgacccagaaataccaaccataggtttataccacgcagtgttcaccactggtgctctgtccaccagaacagaagcataagaatgtgcatagtagcattgtttgtattattgcaaaactgggaaaacctgtatgtccaagaacttcataaataaattatggcatatccatacaagtgaatgtacaaaaccacaaaaaggaataaagtgtagttatatacaacaacatggttgagtcagaaagataaagttgagtgaaataagccaaacaaattttaaactatatcatttaattaaccttaaattaaaaacagcctacactaaaccatactttaacagttgcataattacatagtgaaattttaaagaaaaacaaagaagagactaccatgaaaaacagaatagcagttacccctgggggatggagagggttacgactggaaagcatctcgtgggagacctcctatgtgctagtaatggttcatgtcttggcttgggagggtagcaattatgggtaatttattttccagtaatttgttaagctgataattttcattctttacactttttgcatgtttcttatattttacatacatatatttaaaatatatatatatatatgtatttgtgtgtatatatatatatatatatatatatatatatatatatatacacaaacacataagaaagactctaggcctagatggttttacaggtaattcctacaaaactttcaaggaacagattctaatcttttacaaacatttccacaaataaaaaagatgaacaacttctttcctcattctgtgaggccactgtaaccttgataccaaaaccagacaaggaggacagaataagaaagaaaaaaatattgatcaatctcactcatgaagatggatgccaaattactagcaaattacagtaaataaaagatacattctgaccaagttggatttattccagaaactaaaggtgatttaatattagtaaatctataaaggtaaatcatcatattagcaagtgaaagaggaaaaaccatatgatcatgtccatagatggagaaaaagtgtttgataaagcccaatacccagccatgagaaaaactcagcagcaacaaaaagaaaattagcaaatgaaggataagggagaatttcactgacctatagtaaacagcattttaaaacctttttatcttgaagcaatttcaagcctacagaagatttgcaaataaaactgaactaattcctgattaaccttcacctggtttaccggttttaacattttgcctctcggggtgtgtgtgtgagtgtgtgtgtgtgtgtgtgtgtgtgtgtgtgtgtgtgtgtgtgtttggaaacagagaagttacagacatatagcctgggcagtatagcaagaccccatctcttaaaaaattgctttttagttagctgggcacagtggtacacacctgtagtcccagctacacgagaggctgaagcaggagaattgcttgaggccacgaatttgaggttgcagtagctatgaaagcaccactgcactccagcctgggtgacagaataagaccccatctcttaaaaaaaaaaaaaaaaagttatcagccggatgcgctggcttacgcctgtaatcccagcaccttggcaggcccagacgggcagatcacttgaagtcaggagttcgacatcagcctggccaacatggtgaaactccgtctctactaaaaacacaaaaaattagccaggtgtggtagcgggtgcctgtaatcccagctactcaggagtctgaggcaggagaatcacttgaacccgggaggcaggggttgcaatgagctgagatcgtgccactgcactccagcctgggtgacagagcaaaactccgtctcaaaataacaaaaaaagagaaaaagttatagagatgaccctttacccccaaatactgtacttcggtctgtatcttctaagaacgagaatattctcttatataaccacatcctagaaatttaacattgattcaatgctaattataatatacaacccaaattcaaattacatcagttgtcccaatgatgacctttataatagcttttttttctgatctagaatccaattcaggaccacacattagttgtcatctcttagtcttcatcacttcatgatattaacatttttcaggagtaaaggtcagttgttcagtagaatgtttctaaatttggacttaccaaattgtttcctcattattagaatcatttatgtatttttggcaagaatattgcatgagtggtggtatatcatttttaggtcattacatcatgggacacatgatgtcagtttgtcacattattcatgctattaacttgacttatttgttaaatagtgcaaatatcattcataaaggggaaatgttagaagcatctacaggccaggcagggtggctcacacctatgggcccagcactttgagaggccaagatgggtggatctcttgagcccaggagttcgagaccagcaacatagagaaaccccatctctacaaaaaatgcaaaaattaaccaggcatagtggagcatgcctgtagtcccagctactcagaaggctgaggcaggaggctgccttgagcccaggagttcaaggctgctatgagccatgaacgtgccactgcactccagcctaggtgacaaagcgacaccctgtctcaaaataaataaaataaaataaaatcaggaataagataaaaggtcatggcctgcacagtaagactagaaaaatgtaacttgtcaataccaattcaagtagaaacagaaagcctgaatagtcctctaactactaaacattgagcaataaaaatgtcccttaaagaaaaaacaaaaaaaaaaaacagcaaaagaggccgggtgcagtggctcatgcctgtaatctcagcactttgggaggccaaggcaggtggatcatctgaggtcaggagtttgagagcagcctggccaacatggtgaaaccccatctctactaaaaatacaaaaattagccgggcatggtggcgcgcgcctgtggtcccagctacatgggaggctgaggcaggagaatggcgtgaacccgggaggcagagcttgcagtgagtcgagatcgcgccactgtactccagcctgggcgacagagcgaaactccgtctcaaaaaaaaaaaaaaaaaaaattagccgggcatggtggtgcatgcctgtaaccccagaggcaggagaattgcttggacccaggaggcggaggttgcagtgagccgagatggcgccattgcactccagcctgggtgacagagcaaaattccgtctcaaaaaaagaaaaatagcgaaagaaaagttgaaagtgttaggatggaaaaggaagaaataaaactgctattatttacatatataattgtctacatagaacccaaaagaacatgtagtcaaattattagaaaaataagagtatttggaaggtagtggatacaagaatcagaacacaaaaatgaattgcatttgtacatactgggaatatttagatgatataattaaacatttgcaatagaataaaagaagattggatacctaggaataaacaagcaacgcttagaaggaaaatgatagaacattgttaaaagactaataaagatgacctcaatagatggaaatatttactatattcatggatagacacttttacttcctccctcaaattcccacagcattctctttttttaggacatattccaagcctattttttccttagaaccatgccctgactactttgaattagagtcctttgtgcttttctgctagtacctcctaatgtagttgggtgcataattgttgctcataaattttcattaactccacaaattatctcatggttgttcatccaaataaatagggagggcataaatggcaaagggaagggcacaagcaaaggcatggaggtgcaactgtatatagaatgttcaggaagcaatgcagagagcagctgtctggccagaacaaataatctgtgaaggagaagaagggaagtaccctaaggaagtggactggggctagctgagcagagccttgaatgctggggtgaggcatgtgacctgtatcctaaagagagagagaatgtttcgagctagggagggacaagtgcaaaatggaatttgtagaaagacataaaaaggtcaaaatgggaaggaccccctatagatggccgattttgctacttgtttcttccaagctttgcatgcttgtaaaagattacgtccaccaaacaaactgcattcttaattaattcaataattagttggttttccttttattactcaaactctcagaactgtcactgtttctaacttgcatgaactgctcggtgtaaatgggtactaacaactgatataaagaaaataaattggtgtgatgtgatagagtgtgacgtggtttgggagaggggacctagtttaggcaggatggtctgggaaggcattcctgggaaggtgatctttgagccgagagccacttgaggctctaaagggagagtatgctggcagaacaaatagaacatgcaaacattcccctgagtgggaatgggtttggtgtgtctgtgcattgtcagcacgtggacacatgtgctgtgaccacagagtggtgggaggaggtgaggtcagattggggagtagggcctggactgtgaaggcgtcgtaagcccaggcaggagtctgggctctatcctgagtccagtgggaagccactggagggttgaaactcacttgtcagccaggcgctgtggctaacacctgcaatctcagcactttgggaagccgaggcaggcagatcacgaggtcaggagtttgagaccagcctggccaacatggtgaaaccctgtctctactaaaaatatgaaaaattagttgggcgtggtggcagccacctgtaaccccaactattcgggaggctgaggcaggagaactgcttgaacccaggaggtggaggttgcagtgagtcaagatcgcgccactgcactccatccagcccaggcaacagtgcgagactctctcaaaaaaaaaaaagaaagagaaaaagaaactcacttgtcctacacagcctgatcctagataaaatgtgtgattctctttgggctttttgaaatataataaatagctcaaagatacatgttaattgctatcatcacagactcctaggaatccagatccaacaggagctgtgatacagtttggatgcttgtcccctccaattttcatgtggaaatgtgatccccagtgttggaggtggggcctcatgggaggtgtttgggtcatgggggcagctcatgaatggcttgatgccctccctgtgataatgagttcacctgagatctgattgttgaaaacagtctgggacacctccccgtggcctgcggcacacctgatcccccctacactgtctgcatgattggaagctcccctgcagtccttaccagaagcagatgctggtgccaggcttcttttgcctcctgcagaactgtgagccaaacaaacgtcttttctttgtaaatacccagcctcacatattcctatatagcaatgcaaaatggactaacacacccaggagccactgatcagagcttctcatactttagtgttacaacacagattctgatgtagtgggtctgaagtggggccagggaatctgcatctccaacaagctcccagagatgcctgataaaatacaggatgcccagtttaatttgactttcagataaacaacaaatcgttatttttgcttttttctttttaattaaaagttttattttgacatcatagtagattcacaagcagttataagaaatagtacagtgcaattctgtgtatcctttaccctgtttcttccagtggtaacatcttataagactacagtacgcagtacagcatactgttgtgatactggcatcactacagtcaagatacagaacattccatcatcacaaagatctgttcccctccacccccattccctccttaaccccagatgacaattaacctgctctccatttctatacttttcccgttttaggaatgttacataaatggaatcatacaatatgtaaccttttcagcttggctttttttactcactgtatttctctcgcagttcagctgggttgttgcatatattgagtattgatcatttttttttgtgttttgtgtgtgtgtgttttgttttttttgtttgtttgttttgttttgttttgtttgagacaagctctggctctttcacccaggctggaatgcagtggcatgatcatatctcactgcagccctgaagcctccacttcctgggctcaagcaatcctcttacgtcagcctcctgaatagctgggactacaggtgcatgccatcacacccagctaatttttgtatattttttatgtagaggtgaggttttgctatgttgctcaggttggtcttgaacccctgggcttaagtgatccacccaccccaaacttctggaattacaggtatgagccactgcacctggcctcaattatgtgttccttctttctttttttaaatttttatttatttatttatcttattttttttttttttttgagatggagtctcgctctgtcgcccaggctggagtgcaatggcatgatattggctcactgaagcctccgcctcctgggttcaagcaactctcctgcctcagcctcccaagtaactgggactacaggcacatgccaccacacctggctagtttttatattttcagtagagatggggttttgctatgttggccaggctggtctcaaactcctgacctcagttaatctgcctgcctcagcctcccaaagagctgggattacaggcatgaaccaccttgcctggcctctttttttttttctttttttttttaatagaggcgaggtctcatgatgttgcccaggctggtctcaaactcctgagctcaagtgatcctcttgcctcagcctcccaaagtgccaggattacaggcatgagccaccactcctgcctctgtgtcctttcttactgctgaatagtattctatggtatggatgcactacagtttatataaccattcactcactgaaagccagtgggttgtttcgagtttggggctattacagattaagctgttacaaacatttgtgttcatatttttgggtgaatataagtaagtctccatttctctggcataaagggccaggagtgcggttgctgagtcataaggtagttgcatgtttagccttataagaaactgtcactttatttttacaaatttttagtgtaagtaaaatattgcatggaacctccttatgctaaaatattcgttgtttatctgcaatttgaattttactgggcatcctgtattttacttgctaaatctgacttccctcctcccaggtgataccgatctacttgtttgccaattgcattttcaatagcaaggctctaatctagctcaggttcataattatggaaaaatctcaagcacaaaagtagataaaaataatatgatgaactttcctcagcccagattctagaattatcaagtttgccctcttgcttcactcatcccttttacctgaagtattttaaagcaaatcctagacattttgtcatttcaacctctgccccccgccccctaccacatgtcagtatgcaattctaaaaccagggacattttctgacataaccataatgccaggatcacattaataataactcttgtgtcacctgattcctaattcatgttaatggtccctggttgcctcatacatgccactttgcttgtggtttgtttgcctcaaagtccagatggggtccacatcttgcatttgattgatgtttctttttaattttttcttattgtaagtagagatggggtctcactatgttgcccaggctggtctcaaactcttgggctcaagggatcctcctgcctcagccccccaaagtgctgggataacaggcatgagccaccacacctggccaatatgtttcttattaagtaaccacatccattactactgtgcaggcaccatgccatagcacttacctgcacagacaggccttagaggctctttattatgttgtaaccagggttggagtgattatgctgataccttatgaacattagccccatttataggggatcttgccccattgcacagatgaggtcgctgaggctcaggaagatgacttcccagaggaccctgtgcagtgtgtccaggacccgaatgggagcccagacctgggtgtggcctcgggccttgctctcacttcactgacatgaggcccctgaggtttggcactgatttgcatcagctcctacttgttaccaggattacgttctgtgccaggcacagagatgtatcagtaggtgagtgatgtgagaacaaggaagggacaagctagctaatgatttaattaagtacataaattgcattgagattgggagatgtctggccttgccacagcgtgcaggaagtccttctcagaggggccgggctgccccaggcagtttcagatgtcccaaagggagtgacactgcaggcagggtccctccctcttgcctgttgtgacccagggtgagctggttagagggaggctggaggtgagtttcgcaacctgcagccttggcaaccagggactgtactcagggaacaaaggcagcaggggaaggctggggagaggccaggactgtgctcctgagcctggggcccagcctgccacagagtcactccagggagggggtgaagaaggtggactttgctgtgaggtgtggagggtggggaggaatgaaagcaagggcaggcagagcccctgggggtcagccctggaaccctgctgggagtagacaggccagaggggacatgggcctgagggcctaatggacaccgtggctttcaggtgcctgggagagtggagaggagcatttcactgccatgatcttaaaggccagccttagccagcatggtggctcacacctgtaatcctggcactttgggaggccaaggcaggagatcacttgaggtcaggcattcgagactagcctggccaacataccaaaaccctgtctctaccaaaaataaaaaatcagctgggcgtggtggcacatgcctgtagtcccagctacttgggaggctgaggcaggagaatcacttgaacccgggagacagaggttgcagtaaaccaagatcgcaccattgcactccagcctgggcgacagagcaatactctgtctcaaaaaacaaacaaacaaaaaaccaaggccaacctgacccttctcaagccgatgtgtgtccacatcactccgctgctcagatgcctcccaggactccttgctgcctgcagataatgttctgcctctctcatcaaagccctctatgccctgtcctagccaactgtttggaacctcagagccttccatagcacatatctgttccctccatacaaattgcccttctagaaaggcagggtatgggctagtctggcattttggaagtctcttccagttctaggggtttgttcatcctggacaagaacatactcaaggaatgggtcctctgtcttcaaatatccaaggagttggcctgccacagagggcccagatgtgtctataggtccccaaaggacaacgccaggaccagaagtgggaagtgaggggaagcaggggccacctggaggccacactgggctcgaagtaggaaacattttctccaaattcacaaggtctgaaagtaggatgaattacctcaggaggaagtgagctccctgtccccacaggtgaccaagtggggacaccagctgtggttcaccgctttcatccctggatgttggattctacagtaaaccctccaaaggctcatctgggtgctcataaggagaggggtgatgaaggatgctctgccctaaatcatgggaatgtgctgtgcattttagaagtgctgccattcctagggtcaagaaatgctcctctcatctctccctctgctcaatcccagcctcctctgggcggtccctggtcccacatctcaccctctccagtcaggacatggctcacctatccatttgtccacctctctattgggtccagccttgcaccctgggcagggtgagtagactccatgccctcagcctcacccctcttgctcagcctcctctcttgccctgtcctccagcctaccgtgcccgctggctgcttcagcctcctcccacttaaaacctacctgtggccctgcctttctgacttgagattcctcccctccacctgacctggtcaaagtctccctctctttaaggcccaatttaaagtcctcctcctccagggagccttctctggttcatcccccaggtctcttgtgtgcctctcctctgagctcaaagtatattccttcctgcctcctccataaggtagatggctcctatagcccaggattgtgagtaccgcatctctgccatcacctgcatgcagtctggcacatagtatgtcctcagtgaaaggcctgtatgatgatgatgataaccatggtgtgaggacagcaagagcagaccaggccataagaggaaacattcccaatcctggctctgctgtccttagtacatgattgtcaacctctctgagccccagcctctgcacttgtaaatggggaattcttgtactatgtcctggggtggttgggaggtaaatcaaatattatgagcaacgcagctggcactgggcctggcacatatatgactccctagattatggtttctaaagaaaagctttttttttttttttcttcgaaacaggatctcactctgttgcccaggctggagtgtagtggcacgatcatggctcactgtaggctggacctcccaggctcaagtgatcctcctgcctcagcctcccgagtagctgggaccacaggtgtgcatccctacaccggactaatttttgtagagatggggcctgttgcccaggctgctcttgaactcctggccttaagtaatctgccttggacttccaaagtgctggaattacagacatgagccactgtgcccagccaagaagcatttaaaaacctatttcttatagacatgggaacatgtctgatccagctgcctgcattcaccagtaggaaaacaatcaagccactagttcattcatggagggcatgcctggagccactgctatgtaggaaaggatgggagtccccctgcagaacagtttgtcccctgcccagtgagtatatcccctggcccctgaaacatactgagcaacaatgaaactgggtaatggtaatgagctgtgatgagcttctcctggctaatgtactgagtacttagcaagtactgggcaccgtcttcagtgctttactgtgaatgaggtgctactactgttgtcatttcgtagataaggaaactgaggcatagagaactgaggtcacttgcccaaggctgcaccatggtaagggatgtggcagggattccacccctggaagccagagtctgcctgcccacttcacctctgctacactgtgtgtcctccctctgcccgtcctgccacccctgcctcccagtctccaccctgagctgttgggatgctcatttgaggccatgactatgatgctgttgtaggaacagctgctcccttgactgctgagggtcgtgacagtggcctcacaacctctccctttctggcaatggaggtcagccgtagagagtccccagtctggtcccccacccgcctgactcctcctgggtccttctgtcctgtcttccccctctgccccagggcagccccttggagacttggaggtgatgcctctccaggcagggcggcccaagccagggttctgtggggtctgcgaggggagcaggcgtgtctcccctgatttagagcttgtacaccacatccatcagaagcctgtttctggctgagtgctggcctaatgggcagaaggtggaaatggcctcctgatgataaatgtccctgacaggcttttagcagctcagtcaatagcccaccaggctggctaatgtccgctcctgcctgtggtcctcagcgtaaaaccttttagaagcagagcaatctgccagcccagggcagggcagcgcagggcagcgcagggcagggcagggcaggggaggtggggcggaggggagggctggggtgggctggggtgtgagtgggcagccttccctcatcagctgagaaggaagagaaggctgagaaggaagagaagctgtctagggctaggcccttctgagccacgcccaaccctaaggcgccttccctgagtctgtgggaggtgggaggtgtgtgtctgaatggggctcctgggcactttgcctcccgtcagcccgagggcagcctgactattggctcatctggcttttcttgggaaaccgcactgcggaaattggggcatggccctgggccagagtctaaaggcccggagagcaatcagtgccccacagccaaagacacagtactgctcatggcctttgacccaggaaatgatcccagagaaaggaaaggctgtgtgcaggaaggaggccagggcagggactcacagagcactcactggtgctccctcagagcacaggaagtacagcaccaggctcacacttggggaaccagaggcctgggctcaagcccagctctgcccctcacctttgcagtgaccctgggcaagtccctactccatgctggatttccccaagtctgaggtccgagagagggtgctgggatccattcgcaatgcctgccacaggtgcaggataagacagtgcagctgtgggctccattcctggtctctagagcccttcaagagctacagttttataacagaagtttttggctaatcctggatggacccattttttcagaaaatctgtatttttgtttttaaacaccttttttaattgcaaaacttacatagctaaaaataagacaaagatattaaagccagccatttattccaccatctagatataaccatgattaacattttggctcattccttttagtttttttttctcagttttgacatacaaatatacatacatatacatataataatagcttctgttactgagcacttacagtaacacctgactgttgggctcttcatgcatagtatctcatttaactctcaacaatcctgcaaggaagaaatgattattcattcacattttacagatgaggaaaaagaggcttgcaaaatgtgagcaggtgcacaacatgctcaggttttaattttcgaaaactcaccttgaggacagtgtacaggatgtcctggaggctaagcaagaggtcattggcagctgggcgcagtggctcaagcctataatcccagcactttggaaggccaaggcgggcagatcacctgaggtcaggagttcaagaccagcctggccaacatggcaaaaccccgtccctactaaaaaatacaaaaactagctgggtgtggtggcacgcacctgtaatcccagctactcaggaggccgaggcagggagaattgcttgaacctgggaggtggaggttgcagtgatccgggatcgcaccgctgcaccccagcctgagcaacaagacgagactccatgtccaaaaaaaaaaaaaaaaaaagggtcagtggtcccatggagacctgggccagggcctgtgggtgcagtgtccttctaagaccctagctccaggtaccgccctgccaggacagggcaggaagcatgcacctctctcccctgtcctgctgtagaagaggcagagaccacttgaaagagagaaaattttcacctccctccatgcacatcactaacaaaggacacaagtccacattctttcctttttttttggttctctttctccctctgaatgtgtaggtgtgtgtataattttttgttttcagaactctttgagggtaagttacatccatcttagcccttcatccctaaatactgtttcctaaaaatacaaatattctcttacattactgcagtacattatcaacttatataagtttaatgttgtgataatactgtaatctaccgttcttgtttagatttgttaaataatgtcctttatagcgttgtcccctccagtaggggatccagtctaggcggaggtgtctgatcactttttcctgaggggagagacctggattagccagagtatttccagagggaggcacaggaccacctcctctgtttgcagagctactaaaatgcatgcataggccaggcacggtggcccatgcctgtaatccctcactttaggagggcaagttgggaagattgtttgagcccaggagttcaagaccagcctgggcaacatagcaagaccccatctctacaaataattttaaaaattagctgagcttggtgacacatgcctgtagttcttagcctggaacttgggagggtgaggtgggaagattgtcttaccccgagttcgaggctacagtgaatcatgattgcaccactgcactccagcctggacaacagagtgagaccctgtctcttaaaaaaaaaaaaaacaagtacagtggtctctacacagatggggaggtgatggaagaagagaaggttgggtgttccctgagtccaccctgttcttgaaagtccctctagaaaaaatcccaagactattgattctgcaaagtcaaggactatgttgagtgttcaccttgcaatcagcccctccaacagcacctgtcccctgggcacctcgggaatatttgtgggatggatggatgttggccagttttcttctcagctgtctctttcacttagatataaaaatggctgggggagcattctggtgggtggctcaagaacctggaactagatggtggatgtgggaggtcgagggcctgggtcctggtccctgttctgccagggccatgcaatgtgatgtgcaaaatgagcagattggtcactgccagtccaaggttctgtgactgaactggtgtggtttctctatgaccccaagaaatccaagtctcttggtggagttggaaatagcttcagggctgtgtggcatgggctgggggacctgtatgtccctcccagcacctatacaggaattctcattaggaaaggggaaaatgagggaaatgccctttctatgtaattgaggtagaattcacataccagaaaattcaccgtgttttgttttttgtttgagacagggtcccattctgttgcccaggctggagtgcagtggcacaatcatagctgactgcagcctcgacctcccaggctcaagcaatcctcccacctcagcctcccaagtagctggaactacaggtgtgcgacaccatgcctggctatttatttatttatttatttttgagacggagtctcactctattgcccaggctggaacgcagtggcacaatctcagctcaccgcaacctccacctcctgggttcgagtgattctcctgcctcagtctcccaagtagcttggattacaggcatgtgccaccacgcccggctaattttgtatttttagtagaggtggggtttcaccatattgaccaggctggtctcaaactcctgacatcaggtgatccacccatcttggcctcccaaagtgctgggattacagccgtgagccaccatgccaggcctaattttttgattttttgtagagacggggttttgtcctgttgccatgttggaaaattcaccgttttaaggtgtatagttcagtggatcttagtatattcacaaggttgtgaatatactgtgaataaactgtcaccaccacctaatttcaaaatcattttgtcactccaaaaagacacccctcactcattagcagtcaccccctattgccccttctcccaagcctgaggcaaccagaatcttgccttctgtctccatgaatgtatcgttctgcatttttctttctttttttttttttttttgagacagaatcttgctctgtcgccaggctgtagtgcagtggcatgatcttggctcactgcaacctctgcctcctgggttcaagcgattctactgcctcagcctcccgagtagctgggactacaggcgtgcaccaccacgccgggctaattttttgtattttagtagagacagggtttcaccatgttggccaggatggtctcgatctcctgacctcgtgatccacccgcctcggccccccaaagtgctgggattacagtcgtgagccaccgcgcccagcccgttctgcatttttcatatgcattacttagggttccagataccaggtaccagggggatgcattaatgtgctcaggcaatgaaaccacatctggaacatcatctaagtggaatcacacaacgtgtggccttttgtgcctggcctcttcttctagtgttttctaggttaatccatgctgtagcagggaccagtacttcattcctctttttagggacagtagtattctgctgcatgaatatactgcattttgtatgtccattcttcacttgatgggcatttgggttgtttccactttctgatattatgaagaatattgttgtgaacattggtgaaccagtttctttttttttttttttgagacatagtttcactcttgtcacccaggctggagtgcaatggcgcaatcagagctcactgcaacctccacctcccaggttcaagtgttctacctcagcctcctgagtagctgggattacaggtgcatgctaccacgcccggctaatttttgtatttttagtagagacagggtttcaccatgttggccaggctggtctcgaactcctgacctcaggtgatccacccaccttggcctcccaaagtgctgggattaggtgaaacagtttcttgcggacttatcttttcattttccatggagatagacctaggagtggaattgctgggtcatgtgggaaccggttaaccttttgaggaactgccagactattttccaaaagagctgcaccattttacatgcctaccagcagtgtgtgaggggaaatgcccttttattgaacatctgccatgtgctaggcactgtgccatacctcctctcccatgatcctcacaccaacctgtgaaatacctgtgattgctcccttttactgaggaggacaccagagctcagagaagtgaagtaactcccccaggatcccacagggaataagaagtaaggcctagattcacacccagctctgtcccttatgttttcctgttgactggttgctaactgactatgtgactgtccagatgctaatgtggaatccacctcctccccaaccctcctgggcactgtcttgcagacagggaagttggacccccactacccaaaagtctgcgggcacagaggcaacgttttggatgtcaagtggaacccttttgatgattttgagatcgcctcctgttctgaagatgccacagtgagtgtcagcccctgaggggcttccccttcctgaagagtgggattggggtggttggggtggaatggtacctgttcttggctctggtgcccctgactccatcgcggaggtgaggtcactgtgtggggaggtgttaagttaaggtagaggaggagacattcttggtgctgtaggactagcggcaccacccctcctctctatgggccttagttcccccccatataaaatgggcataatagttccacccagctaataaagcccagtgaaaatgtatattccgatgggaaaacccatccttcggggagctataaaaggctatgaggggcatttttatggtgatcagaaaagatgttccacttaatcccatagtgaggaagcgagctataaaaggctgtgagggccttggatgaatgtggacactaaaaccattccagcagcttcagtctcactcacttttttgagcccgtgttctgtaccagggttatcatccctgccccaacaatgttcagtgttacttatttacaattcattttgtacccacttctaaaatatggtggtatggcttaagacaagaaccacagatatgccaggttcagtggctcacacctgtaatctcagcactttgggagactgaggtgggagaatcacttgaggccaggagttggagaccaacctaggcaacatagtgagaccctgtctctattaaaaaattaaaaaacacagatatgatcagatgattaaaataaagataaaagtcattgtcaccatttattgtgagcccactgtattcctaactgtcatcacacttatcatttcacagtctccccagcaaccccacaaggtaggatatttttctgatggagaagctgaggatcagagaggtacagcaatttgcctaatgttacacagcctgtgggaggcagagcaagacttcagactgaggcctgtctgattccacagcccattctctttccaatgtgctgtgacacatctttaaagagaagcagccacagatggagaaactgaggaaatactagaaatgatggctaagaagggttgcagcagctaagctgctagtttagctaagagctacctggcagccaaggcaaaatgggcaacagaatgtattgcaaaaccttcagttagatcaaaagaagcagaccagttcatcaggaaaggaaggcagaaaattcaaagaggatttgtgtcggtttccatatagcagatgctgaggaacgtaaaggacagtgtctgccgaggtgatttcaccaaagggacaatcaggtcctgtgagaattggccctgtccccagggagtatagggcctctggcaggatatcaaatatctgaaactgtccccacttttgtgatacctgccttttcaggactgctttgaaggctcccatcaagatctttataaatctcttgctagcctcattgcctgccactgccccttccccgatgccccagggcaggacgtgactgttgggggactgaagaaggaaggggctttcctccccgaagctatgcccacagtgaatttatggggtgttcctccctgccttcagggcctggagggcacggttgctcctctagcagtggggagtcttctctgcttcagtgttgcgggtggtaccttcatcttccaaacatacctcttcagagtgtgtcttcctcccggggttctatgcagtgacagccctcatcagaccgaagtatctggagcctgtcactactctcgtggggttggcttcctggttttaaatccaagatgaccaggaaataaatatttgctgaattgaaagcaaagtcgtctacctgaaaaacctgtatacctctaagggaaacagtgcatacaatcaactaggggccagagaaccttgcaggaccaataaggaagatcaagtcagcagcatcccaggatcaccttgtactccatttgtatacctctgtgacagggagcttactctctgccatggcagccccctccatcttcagacaacactactctggaaggaagtcccagcacctcttctcaggccctcaccatgaaatacaggcccatgaccccatccagcccagcctcctgaccttcagagtttcctcttgcaggccatccagggtgcacctccaaagcaagaagtttgtccctgccctgctgcagagacctcgccggctccctagtgcctgaggatgcagcctaaacccttcatcctggcatttgaggctctaccctgggtctttgggacaagaagaacactgtactttggggatatcctagcttaggagacaggcctgaaacccagccacctgcccaccacctcaggccagcaggatgacaaagatctctcaagggcagatttggaggcctagactcatccctggtcagcgctggcccctgctcaggctggaggagcttggggaagcccctgtctgtctgaggaccctcagctgcccctccactgcccctcaatgcccatagccactgagtgggaggtggctatggagagagctcccttggtccttctgctggtcactgccagatctgtggcttaggctggtgacggtgccaaggtgccctggctaatgctgccttgggccctgtctcccctgccagattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgagtctgggtattctttctctggggcagccccaacaagttcccacaaactggaatacaatggaaatgtattctgtcacagttctggagaccagaaatcgaaaatcaaggtgttgggagagccagctccctccagatgccctagggaagaatccttccatgcctctcccagcttctggtggctccaggcatccttggctatagctgcgtcactccaggctctgtttctgtcttcacacggccttctctctgtgtacctgtcttccttataggaagaggagagcaactatcattggatttagggcccacctaatccattatgatctcatcttaactaatttcagcagcgaagaccccatttccaaataaggtcacattctgaggttccaggtggacatgagttttggggggaaccctgttcaactcattatagcctgcccggagtggatgggatggcactgcccagaaaatcgttcccccgaccctgctccactgacaatcaagcatgcaggcagtaggccctgtagattgggacccacagtacaggagacctcaattctattccgactcagtctctgacctgcactatagcctgggaaagtgccttgacttctctaggcctcagtttcccaatctgtacacaaatggaattggtggcaccatagctatggcctttcagttctttccttttgacactataggggtttacagagacacctcgggaccctctgtgttggataaaagggaggtggggggccggacatggtggctcacacctgtaatcccaacagtttgagaggctgaggtgggaggatcacttgagcccaaggatttgagaccagccaacatagtgagaccccatctctacaaaaaaatagaaaaaattagccaggtgtgggaaaatgcgtcaagtagtcccagctactcaggaggctgaggtgggaggatcacttgagcccaggaggttgatgctacagtgagccatgatcatgccactgtactgcagcctgggcaatcctgtctcaaaaataaataactaaaattgttgtggggagcactgagggaacctgggccctcgctcttccgatccacagcgctttctcatctgtttgtatggggtgtctgcagagctgctgcgtgtatttgtgctggttgttctatacccaacttcagggggcactagtcacgtcctagtctataggaatggattgccctggacctctgcatgcacagcctgtgcagctaaacatacagccctgttgatctgtgggaggtgcaaactgctgctaataactgaaaccgcctggattagctggttccctggggtcctcccagcatggatgttttgttgctcagaggcaggtggcgttttcctttcaccactagacagcctggccctgggattccccctcctgccacaagcagcttcagcctgcacatcatcctcccactgaggcttcttggccaggctgccagctgcgccaccctcccagggatactgtgtttcactgcatcctggccagcatgtaactatgaggcccaggggcaaggtggcccctgtgctcagagctggctctctgccatgcaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggtcagttctgggccaggggctggctcaggctcagaggagcaaggagcagagtggggacagagagaggcttcagagaacaggacagtgatgctgtcagcgtctgggctgcgccttcacaggcagcatccctgtctgtcctctcgggattgctggaaggtgggatatgtcctttccattttgcagatgagaaaactgaggcccgtgagagatgaaatgactcacccccatggagagctgggatctgaacctggtctgactccaaagcttgttggcgtgcctcagctctggccagggggtcaggagagccgacgataccactgtttagccactgtgcagccttgggcaagcgcttcctgctctgagcctctgttttctcatttgcaacaatgggctgttagtccttcctctccaaggattagataagacaggccaggtgacagtgcccgcccctgtagggatgcccaatactctttcagcaagaacagggcgctgggcagaagtttgtttctgttcttgctcagaaaaataactcttaacaaagatagtggggagagactccatgtggatgagagggatccaggtggtgcccctgggaagaatctccaggcagagctggggtgagaaagggaggcctcccaggtggagcggtggcataagcaaagcagggaggccagaaaccccagctgcccccgatcctctactgtctctccaataccgaccgcacgtgtccctccaggaggccagctacaaagggcaccgggccagcaaagtgctgtttctggggaacctgaagaagctgatgtccacaggcacatcccgatggaacaaccggcaggtggccttgtgggaccaggtgagggctgcaccccacccctcaccatcacccctcagctgagagccagtgtcattcattcatgcatgcattcatttagacacccatttatgacacacacatttagcgtagactgccaggtgctggggatccggggatgaatagcagggagatgctgacagccccgggcgagcccagaccctgtgtatcttgccacccaaggagggagatgggtcaggacccaggggagtccgttggctagaggaggggaggtagctgagtctgggaccaggactaggaggaagggagaaggagagggccatctgggctgagggtgcacctggagcaaatgaggtactaacgggtatggggagaaggagctttcattgggacagctgagggtggagcagggtagggtgagggccaagctggcggtagtattttgagggagcatttgacagagtttcaaagactggacaaatcacattttctctctgagtctccttcttcatctattaaaataaattttaaaaaacaggtaggggaagattggaatgagatcgggtgtgtcaaaagtgatttgttatggccaggtatggtggtacacgcgtgtaatcccagcacttcagaaggccatggcgggaggatcacttgaggccacgaattcgagaccagcctgagctacacagcaggacccccatctctgcaaaaaatcagcggggtgcagtggtgcatatctataatcccagctatttgggagactgaggcgagaggatcgcttgagcccaagagtttgagactgcagtgagctatgatcgcaccactgcactccagcctgggtgacagttagaccttgtctcaaaaaaaaaaaaaaaagtgatttgttaagggcagaaagctgacaaaataggtggcagcagcattttagtgcctttaagatgtcatctccactagagagtagcccacacattggaactcaagaaccagggacatcttccccccgcacacacatataaaaaaatcacactttttctctgacacacacactctcgcccagagcaccatggcagcaattcttatctccgggagcaccactgagggcccccaggagtgacccaggccttccctgcctccccttcccctgcaggataacctctctgtgcctctgatggaggaggacctggacggctcctcgggcgtgctgtttcccttctatgacgcggacaccagcatgctctacgtggtggggaaggtcggcttggcacgggagggaggtgacctcctggacccctgagacagcggcagacagcagcctggggccattgggaacacagggcagggatgggcaggcctcgctggccactctttccctgtgagaaggaacccctcccaccctcctggctccctaggaacacctggagccagggctctggctggacaccttgaccttgtctcttcccaactccaggcccagatgtggggggaccattggtgtttctcagcaggggcacctgctaaactgggggcagaacaggtctccactgggtaggactatcccatgtctggcagccctggcccctgcccaccagtgccaagaacagcatctctccccctccatccaagtcattatgacaaccagaaatgttccccatggtaagaccttctggatgacctctgaggccaccccagttctgacttttgctgctgctctcagataggagcgggatttggacttgtcttcccagagcttctgtcttagaggaaaaagggtgggctttgggtcatggtgggggaggattgaatattaaaataagggcccaggcccagcacagtggctcatgcctataattccagcactttgggaggccaaggtgggagaatcacttgagcccaggagttcaaggccagcctgggcagcatagtgagaccccatgtctacgaaaatgaaaaaataaaaaattagccaggcgtggtggcacacacctgtggtcccacctactcgggaggctgaggcgggaagatggcttgagaccaggaggttgcaatgagctgtgattgcactactgctctccagcctgggcaataaagtgagaccctgtctcaaaaaaataagataaaatctaaaataaaatgaatatcccctcatcaccctcctgccttgatgacagggcccccagtttcctggtgttcccttgagtgagatgggtttgccgatcatcaaaaaaagccaggtctttgctgcatggctgggttgctgatgagctgatgagctccagctctgaatctcaccctcctcttccttctcctcctcctcagggagatggcaacatccgctactacgaggtgagcgccgacaagcctcacctgagctacctgactgagtaccgctcctataacccacagaaggggatcggtaagtgagggacactgaagttcatgcctgtaatcccagcacttcgggaggccgaggtgggagaatcagggtcagggcttcagtgcggggtctggggagacagggatgagtcagatgggaggagagacagcatagcaacactctgacttggtgggggctgtacttgacgtgtgcaacagcacaaaggaggaagtcagggaaggcttctcagaggaggcaacattggaggaactgaaagaggaagcagagcccagcaggggagagagggatgtgttctaggtcaaggttaagcagttaccacaagagcagagatggaaagggctgacctagaagagcctctaggaagcagtcctcagttcctttctaagtgtgcttgaggattaaaaacacagctatatttctgtaatctacaagaaacccactttaaacataaagacatggctagattaaaagtaagggactggagaaagatgcaccctgctaaccctactcaaaaggaatctggagcggtttgattaagagcatttgggtcacaggagctgtggggatggagatggggaaccttaagcagagcaaactgcctataaaagttcagctaatccagcactttgggaggccaaagctggaggatcacttgagcctaggaattcgagcctagcctgggcaacaaagtgagactcctgtctctacaaataaataaaaaaattgaggtgcatacctgtggtcccagctacttgggacgctaaggcaggaggatcgcttgagcccaggagtgtgagactgcggtgagctatgattgtgccactgcactccagcctgggcaacagagtgagaccttgtgtcaaaaagaaaaaaattcagctaaaataatttaaatctttgaaggtgaagagtctgattaattcaactccatttcccaacatagggcccagcccagtgtcggtatttgtccctgagctgttttctgggaggagactggtctctgttcaggtccaggtgtgcagcctggctttggccctaacactgtggccccagcctagccagaacctcttggccctccctgtctgccttcaggtgtcatgccaaagagaggactcgacgtgtcctcctgcgagatcttccgcttctacaagctgatcacaaccaaaagcctcatcgagcccatctccatgattgtgccccggcgggtaagggcagtcgggaccgcatgggaggcaggtggggaacctgtcctggagaagacagacccagggctgtcgggcaccagagcctggagcccacgttcatggggcagccacagagcggcctttctcacagccagtgtgacatcagtgggcgtcaggagtcctgggtctcggtccacctctgttcttgagctgctgcgtgacctcgggcaagtccctttgttctctgggcctcagtttcctcaattcagcaggggttggtgagagcctggactcccaggtctaagggcctttcccatctgagcagcctaccctaccaccctcctcactgtctggatttctcctgcagtcagaatcctaccaagaggacatataccctccaacagcaggggcccagccctccctgacggcccaggagtggctcagcgggatgaatcgaggtgaggaaggcagagaagaggcccaggcaaatgtgacaggaacatggcgtgcccagtggccccaagcaattgagaggggttgggcctggatttttcttctctcatgacctcagaagccatgcccttgaccttcagtccccagtgggtagcatggtcacatacaggtccagaaagtcagggggcttgacccaagagctcagaaaactccaactcaagggactttgccccacggaaagcttctttacactctggggctatgtggggtgcctggaccacctcagccagactccctgtccctgttccccacccctacctctgcaattcttttttttttttttttttttttttttttgagacagagtctcgctttgttgcccaggctggagtgcagtggtacaatctcagctcactgcaacctccaccccacccccaggttcaagtgattctcatgcctcagcctcctgagtagctgggactacaggcacgtgccaccatgcccagctaatttttcgtatttttagtagagatgggggttttgccatgttggccaggctggtctcaaactcttgacctcaagtgatccacctgcctcggcctcccgaagtgctgggattacaggtgcgagccactgggcctggccttttgcaattcttcttgacccaagaagccctccaggcagcaacccccacccaggtccctctgcccactctgcctgtcctgagccactctcccgctcctgccaacacgggggccagcccagcagaagcagtcaccccagctgctccctctcccttccacccccacaaacttccttcacccccaccccagtggctgagcgggcctcctggtgtactggaagagcctctgccttggggggcagcggaccagggccgagtcctagttttggataaccttaagtaggttttgctccctgggcctcagtttcctcatctgtagccatgatgccagcctcccctgctttctggaggtggtgagagaactaatgaacttggtagatggtggggtgcagtgtgggtgggactgtccttacaaagcaagggcaaggtctcatgtgagtttgaagtgtttgggggctgcttcagtgcacgcaccgtgctgttcctacaaaccaagcttcactctgagggtggcacacgtgggtatttgtatctgttagccctgctctgtgggtttgggcctgtccacaggtagctgtatttcccacacatgttgcatgggtctgcatggctctgagtgtctctgcatgcctgcctgtgtcattggtgccccatatgcccatcttcccgtgggcaccccgtcctcacatggctctgcttcccttccagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgaggtgtgaaggaggacggggtgggcctttcacatggggcagctggggtggaggggaacagatccaggctgagaagaagggagaaaatgaggcatgagaagaataaccagctgtgtggcctggcctagtcacttgactcattttgttaattcattcaacaaacaggcagtgagctccatcttatgccaaaatgatgggcatacataaagatggtgggaggctgggcacagtggctcactcttgtaatcccagcactttgggaggccaaggcgggcagatcatgaggtcaggagttcaagaccagcatggccaacatagtgaaaccccatctctactaaaaatacaaaaattagccgggtgtggtggcgtacacctgtagtcccagctacttgagaggttgaggcaggagaatggcttgaaattgggaggtggaggttgcagtgagccaagatcacaccactgcactccagcctgggcaacagagcaagactccatcttaaaaaaaaaaaaaaaaaaagatggtggggaccaggtgaccaggtgcagtggctcacacctgtaatcccagcactttggtaggccaaggcgggtggatctcttgaggccagaagtttgagaccagcctggccaacatggcgaaaccccgtctctactaaaaatacaaaaattagctgggtatggtggtgcgtgcctgtagtcccagctactctggaggctgaggcaggagaattgcttgaacccaggaggcagaggctgcagtgagccaggatcacaccactgcgctccagcctgggcaacagagtgagactctgtctcaaaaaaaaaaaaaaaaaaaaaaaaaatggtgggaaaccatctgtaaaatggagagggtttgacctagtgggtatcaaagtctttccagttctgacattataggactttctgtgctttcaaagtccacatttgtttagtgcctactgtgtggcagatcctggggtaggcactttgatacagcacgtgattgaattctctcaacagccctggaagtcagtctgtagtggctaagaacacagaggctggcatctcacagatggattctgatcctggctctgctgagtactaatttagggtcttagacccagagactgaatgtctctaagcttccgtttccacggtggtacggtggggacactagcactgccacccttataggggtgtcacaacgttccagtgggataacgaggcccttagggcatcactcaatatctaacacccattctgcacagagggcagttttctgaccccattttccagaggaaggaatggaagctcagagtgggtaagtaacttgcccaaggtcacacagttcagtggtggcgaaaacaccaatccccagacttcagagccaggcatcctttcctctatttcatggaggatctatggaagcaaaatacatctgaaacattccagtcttcttgaatttcatttattgggtgaagtaaacaaggtgtttgtaaaagatctatgcagtgacagccccatcaggcctcagccatgttaatgtgaccgcctccacctttctgagtcaaagagggatagtggtttagctttcagctggtgtcctgacaccatggtgatcctgccttccgatctttcttccccagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatgttcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccag

SEQ ID NO: 14386 - DNA, 61399 bp, Human
aaacctgcttcctctctggccaaattagaactcttgtccccaccacccccaccctcagcaccaattgacccaccattcagggacagaagactgaatcttcatgaggcttgagatgaggctgagtgagcgtttccaaggccatcttctgcacatgtgccttgggcagaaacaagtctctttgggaccttggaccagcccatcctcttccagggatgtccccaccccatccttgttggcctacagaggctactgtgagtcagaggctggtgctaggttctagccccaagcctggggtccctgggagaggccaggggttggtggccaggctgcagagggactttctgaagtcttcatttaaagggcatggaagggcactctggtgtcatgcccaaggtcggggctggtgagtcagaggctgaagttccaatcccattccagaataccacatgaccttagacaagctggcgtcaccaccctgggcctcgcagcctggcctgtgaaatgggagagtagagcttgcaagggaaatggtaaaagccgccacctttcccccactctccaccctctctcccatcctgacatgactttggggaacatgcaagtatagggttcaatcgtcttcatgacttttctacttttgagcctctctgggccttgactcctcaaggacatgaagacacaaagggcgcttctggtgaggggaacagcatgagcgaaggcccggaggcagggaagctcccgagcatcatgctggggcagagacccccaaggggatgcgcaggtggcaacaagaggagtaaagggccctgaatgacatgctggggactcagcccccagccctgcagagggccccccagtgcgggcaggccaccaggtttccacaggaaggcccttctcggtgggcaggccgaggccaggcgtgagtgctggcaatgccacttcatgtgtttcccgttgtacttagtcccaactcccataaaagccccagaggtgccacccagccacacatgtggacacctctccctggcaacaatggtggtggacaatggcagggagtcagccgcagcccaggggcgaggtggcatggcagggagctctccggccgctggtggatccgggctctgggcactcggtgaggggcccgcggggctcctagcccgcccaggccaatgctggccttaattaagaaggagtctcccacccaggagccaaaccaccctcctggccacgcccactgcaaccgctttcagttctgtttcttgggccgcgtgctgaggccagcctcacaaataaaagccatcacttttctatttctctctctctctctctttcttttttttttttttcttttccaaaaagagaggcagccacaagatcttctaaaaggccgtgacatcacggcccaggtgaccgcggcccagccaatgagccaaggccgcgagcaggcttctcgcatcctgtgagctgaggttgggttgacactgggaaggcctggtccctcaaccacagaaccacaaggccaggcccttgccgcctccagggccctgcgcgggagctggttggctcctggtgctccccacccccggccgccctcgtacccaccagagcctgggctctgtcaagggtaagcctcattcattcattccccgtggcactggaggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttgggtacaaacagaaacttactttccttggggatttttttctctctctcactcacacacactctcgcgttctttccttttttctttttcgtagcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcggtgagtaacaatagcccagggccctgggtggggagctgtggccaggccccggaccacgtccctccactgaccgccctggctgccctcaagcgcacagcctgtccgcctaaatccgctggcctctgaaagcctgaggtgggaagaggggttggtggtctctgtggtctcttggcgtggaacatcgctgtggcactttcatcctccgctggtggggacagtaagccgtgggggcgatggatactccaagacctcaagacctcaaagggcagccctcagaggggccaagggaaactctcagggaccctcggcttgctgcttcactaacagggccccagggcctgcagccccagcccctgtcctgcctgggactccccacctgggctcaggaggtcactgctggcaacttctggggagagctgtgggatgcaggggtcttcctggagaccaccgccaacattttgtgtgtaactcctggggtatcagaagcagagggaggagaaggaagccacaggcttttgtggaaaactgcacagagctgggctgcactgaagctggacctgcacggggcagggggacagacctcgagaaagttcgtggatttggccacggaagaggagaaagtgtttctgggcagcttttgccttttttggtggctgcagggatgcagagttctgggttgtgtctcccagcaaggatagggggtctgggatccccgacctggagcctctaatggggctgggactcatggggagacttctcctgcctctgtctggcatttagggctgatgcaccctggcctcagacaccccctgctgccttcctcctccctagcaggagcccagatggggctgtgacacctgagactggggatcaagagtccctgagctcaagtcccacggctcagtggcttccttgctgagagaccttaggaggggagttacttaacctctctgtgccccaaatagagtcccctctgcttgtggaattctcattgtctgagcctgggggtggaccatgtataagggcagtgcctctggatggttccagaacagagaggctgcatgagatctagaacttcagggttgggggctggtgctgcctttcctcagccgaggcagtcagcagagatgcagaggtgggtctgcctgcctgcctaccctccagcccattggcctgccctgccgctggctgaccgagtgattcagggctgctgcctgggtggccggctcggggcagggacccagacacatttgggtgtttgagtcctcaggcttctgggaaggcttgtctgagagcggggcctgttcttcttccctggtgaggccaaggaaggctgtgctgctgcagatggggactgagtcggggagtgaagggggcctgctgtcccctgaaatgggggcactcccatcaaacctagctgtagctgatgatgagcggcagccccaggtctgagagctgagagctgtggctgcttccttggagttgctgctattataacgttgttccctttgtagtcctcggagctaattaaaggcagttctgtggcaagaaaataagagtttataaaatccatttgccgggtctttgtaatctgtatttctccttccgtgcgcaagatggagaaatgtagggtttaaaacaaaggaaccttgggagacagggctagagccccggtcggcctgggctgggtcctgatcctcggagcctgggaggtggctggcagtagcacaaagggcacaaagggagaggtggctttggcccaacatgtcatgtatgcgcccagagacaggaggccgctgggcagagcgggctgatcctggccagcagtggcacagaaggcgcctcataggctagggtctgtggagatgtttggatctggggtctgtggcccgagggccttccctccacttttgtggagacctgtctcccctcttcagccttctctctcctgttcatttctgctcacgacgtgctcgccatgggggcctgtctcccaaatcccatccctggaggcttacagggctccagctgccaattccttcctcaaagagacgcagccccagggtcccatttgcagggtgccaaccccacgctgccccctacagggtccctaacccaccgacccttggcagtctcagggaaccttcaggttcctcctcggagttgcgtttttaaacgcgtaagacaaaatccaaaggattacaaaggaaaagaaatcgatggaaataccattgtcaaactcagaaagcaagctggtgacatattgactcacgttttccatttgttgaactccatttgtctgtgcctcttcaagaactcactgagtgacaagaccccgcggtgggccatgcagttgtgatgagcatgaacaatatttcaggtcatccctgaccccgctgtgataccagagaacacctgtgatttccactggtggaaaatcgccatggaatatgatgctaaatttcagctagaggccagggaaaggaaagacacggttatctccagcccagtgtcacagaccccctaaattatacgcaagacaaaaactccaggtccatccgggtctcgggttctcagaatcttactcgggctgttctctcgtccacaggcttttaccagaaggggaagggtctccctgtgccccccactgcctcctcttcctcctacctgtgtcttccaaatgccatcccatctcagtccctgagcaaagtgtgatggagccagcaggttttctgaaatcaccgcccctagagagttttaaacactggattcccagttcctacctcaggctgtggaggattctccattcctacctcagactgcggaatcagaatctctagggtttgggcctgggcaggtgtggttttgcaaatcccctaaagcgattctgatgtgcctctcaggcaggcttggggactgctgccagggaagcccagtcccctacctgcctctgccgcctgtgtgctgtgagactgtgtctgagtcacttgacatctctggatccgtgttctctcatgagtaaaagggcacgagtgagttgcatttggtgcctcctatgtgggcttctctgtctcccccacctgacaacccagggtggtccctagaattatcaccgagctcctactacctcagggtccccatagaccaacggaagatgacttcccttttgtcttcactggcaaaaacaggctgagaatgaagcatcccatccatgcctctgccttcaggcacctgtactcagccagtgccacagcctgtgcaggggccttcaaggcagcaagggagagatccagacccctggagagtccgactgcttgtgcatgacattcccacggctcccacccagccctcccctctcagtttctctgactttgagctaagggatcagaaactcccctcagttcactgtggagagaaggggtgtgggaaaagggtggagaggcatttggttcccatcctgcagtagaggcgtgagcaggaggtgagaagagggcaacgcctaccctcagggctggtgcatggatggtggaattctagaagctggaatggaaggtgtgagagggcacaggggccccctggggtctacccccaggcaggacaagggggatttattctccctgtgtgacaaatggggaagctgagacctaagagctgtgatccagacactctgtgtaactaaggacaagtcccttcctctctctgggcctcagtttccccgtctgacaattatgggccaatggccctgaggaccccttgcccatgcacggttccactgggggccagaaccttcattctgaatctgcctcatgaggccctcctctgcaccccctggggcacccccccctcacaccaggtcacctttgctgaaccctcacttgtacccccacaggcaaacactcaccagggacactggcagtgggtgcccctccagggagggaagccaaggaaatgggcccaaactgccacatgtaggctttaagggggctctggggcggcgggggggcaaacgcgttcatctgtttagtcagtcatttcccaaaaacttatcgaggtgtagagtatcgagattccagcttgggctttagagccaggctctccaggttcaagtcctgactctgccctctgccgtcacctgcatgagttacttcacttctctgtctctggtttcctcatctgtaggggttacaccaaccttgcagagctatggagagaattaaaggagcatgatgcctggcacagagtagttgctcaataagcattttccatttgatgaacaccatgagcatggccttgtactgggagcccgggggaaactgggtcaggatctccatcctaagagctcaccatctggtgtagaaaaagatgggtcaacagaaaattgccctggggcgtgacaaaggttttttgggagaagaaccagggctgtgagttcaaagaggggtactagcccagccttgggaaagagagaacaagtcctctggaggagtgacttggaaactgggtccctaagggtaaagaggtaacaaagacagggaaaggatgttccaggcagaaggaacgtcctgggcaaaggtgtggaagcaggaaagtatgagctggctcgggagccacagggagggctgggagcgtggtgtgggtctggccgaggtccccctagcagtggttggagttggccggcagctcctcccctgaagatgcctgggagaaatggaaagtggactcttgggtatgaggcaggcctgtgtggaggcagggggtggacaaaatggccctgggcaggtctggccgagatggtctgactcagaggtcaccggacagggaggaggctgcccagaccagagaggtcagtcactgtatcctttccgaaggtccaggaagttccaataacaggggactctctgttttagcactgaaagctccacgtcccaggaaaccccttcatcccaggcaacccctgatggctggtcaccctgagcacatgtgtccatggggcctccccctccccgccatccctgggagaggaacagactgaccgccagcccttccgtgcccactatggcgcttgcctggcgccacgtctgctaggtccctttgatggcggcttctgaggctgccctgcacacacccgtctccccagaccaccctgcctgtccaaagtgccccccaggctggaaaagcattcctaggagccccccactgcccacagggtctaggcaggcatgagccgaccccacacagcgggactgtgtgtccaggcctcaccgcacccactctggcgggctggaggcccccagcagccccactggtcatatagagggctcattgacgcctgggcctggaggtggccgcatcaaagcggaggctccctcggttacctggagggaggaggccgggagacggataagcagagcctgaaaacctgaccttccagcgggctgtgagaggcaggaggagagtggcagcctctgaccccggccttgccactgagccagtccggactcctccatgggtggggaaacaggcctgggctctgggttcagtggggcagccccaacaccagctcttattgccatctcctggggatgccttatctgcagactcttcctcaaatctgccacccagagtgtgcccccaccccccgtagttggggaatctcacccaatcttccagactgaacccaaacaccccctctgctaggagtcagtgctgggacacctgcagccactggggagccctgtcctcctgagcttcagtccgtgggcctgccctgagactcagcgagtagttccctaccttgcttagtggaagtaaagagaaggaaggaaggaagggaggggtggagggaagaaagattgcctttagccctcagtggatctacagcccaggcctttgccatctgccctaaaatagcacctcctgaagcccctggacacagtggggatgggaatctcgggcctagggctgggagtgggactctggtcttgctttgagaagtcacaagaacaaggaacagtgaatcagtccaggagcatatcagagcccggaggcagagagttcccctcctcatttcatacatgacgaaactgaggtctaaagaggtgtgtggtcttgtaaaacattgaattcagcagcaggaaaactgactttccttgcctccctggggtccaatcatccgccttgcacacagtttaggagtcagaacaatctaggcttaaactgcatggtagctgggtgacctgacatgttaattcacctcttaaggtctcagtttcctcctctgtaaaatgggctagtaacactgacctcaaagggtggttgggaggagcaactgtggccctaccctgagccccgcatgtggcacctggtacacagggagcactggcctggcacaggccggcctcctgatcggctcgggcccctctgcgccagcgtgatcccctgccactcaacagatgtttccacatctcaccctcctgctctttctccagcgccaagccctggttttttcagggctagagagggctgagcaggcacaagactagagggactgtcagaccccttgtcaatggctcccagggataaaggaaggcactcttcggagagaaagcaatgtaaaatgcggctataagcctcagctgcagccaggctctgccacttcctcgctgtgtggcgttgggagaggtgcctcacctctctgtgtttcattttcttacctgtaaaatggagaaaatgaatagcaccccctcaaggcatgttgggtaggtttaatgaggtagtgtgtatcacgtgcacagcacagggcccggcacagacaagccctcatggaatgccagaaattactactatttaatgttcctcctcctctgcaaaagccttctgtctgactctaagcaggatgtggaaggtgagaaaccctggcctgtcttctcaaggcccagcttcatggccgcccccttggggagccttcccagcccttccctttctcccctccaggcggtgggggtgctctgccattgctgcccctcactactcaccccacaggtgtccaaagggtgttcttgggagcaggggcaggctcacaggtgatattcagcccttctcactgaatggatagaggaaagaaagaaagaatggatggatggatggatggatggatggatggatggatggatggatgaacgaatgaatgggctgacgattggtcagcctgagagttttccagcttctccctcacttcccccttcactgtctggcttcttctttgaaacacttgttggcgcgagcctgagcactccggtccaatcggtgcaggcagcgtgaaggtttaggttcctctttggggttttctttcgagtctgggaaaagtgtttttggcaaaaggttcagacttacgtgtgggcggaaagggcagacgcatataacttatgatttgaagggtgaccaaagtcagccccctccaaacatccttcaacgtgggacatggtgactgagattccaccagcacatgcagtccctgtgggggggagcttttgtaaatgcaggtcccttcccatcatgcacacctgagtgtccacagtctgcctgattccttggcctttgttgagaggagttaaaaggctggagcagaggaaacagagggcatctgggggacggaacgcttggagaacgcaaagggaaaggcggatggagtggaaaggggtggggaggaaaggaggggtccattttggtcatgcccctattcccaaacccaacttgcctgggcaccagggctgaggaccagcacctgtggcttggcctccagtgctccttcctcaagcctgagttctgtcccaccccacctccgtggggtaagcaggggcaggaggggaggcctgctgacgtacctcccccagctcttcgcacccctgtgtctcgggaagaggtgctaggtccagggggggtggagaaaggacctccaagtcagaagtgataaagagcccatggagagagcctggtgcccccacatctcctacagagcagctatatcccttcccagggggagagaaagccacctctgagagcaaagccacctcagaaaaaagactagagggaaacactgaaaagtccatagtagttaatactgtgtggtccgccatgatggcaggtaacctttattttatattcttttgattattgtgtattttccaaacttttaatacttgtaaatttaagggaaaacaatttttgttttcagagaaagaaagaggaagaggcagtcccaccctcccaggaacaggcaagctggggctcccatcagcctgagctccagcctgggaacggcctgctcccacccaggcaaggccctgctggccaccctgctctctgttcttcttcccaaatcactgtgtctgtcacctgcctccttggctctgccctgtcgggctgtggagcaagggtctgccccgggctgcgcagagccatgcatacagtaggtgctcaggaaatgcttgtgacctgaggtgtggtcccaatctgcagacagtttccctggagaggtgggcctacgtccccagcggacttaggatgtgaggtgggcgaattggttgctgctgattcattcaatgaacatttattgagcatctactgcatgcaagcactgttctgggcactggagatgcagaagtgaacacaatggacaaagatgccttctccctggggcgccacattcctgtgatgtgtggagagagactgcctcaggaaccaccctcccccccagtgtttttcagtgtcccagctttccatttatagatggggaaactgacactcagagaggaggcagtccttgcctgaaccccgacagccagggagttgcagatgctgttctaagctccagagcctcgagattcagcccagaccttagcctaccaagccctactaaggtaggctctctcctctggccacccacacccctctggcttaggtccttcctacctatgcagaatcttggcctcctggcacttccataaatgctctggattccccattaaatcctcatcacagctccgtgtgctgggcatcaccacctccattgtggagatgaaaacagactcaggcagatggtgggacttgctgcaactaatgtttaagaagaggaaagaggaccttgagtcatcctgtggtctgtctgacatcaaaccagcccgtcaaactctcccttctgcccggaagatatcttctcttccttggcctgagggcaccacctccatggagccctccccgatacctctaagcgaggtgattcatatcctcctctatgcaaccacagcatcttcaggcccttctcaaatacttcctgaagtctttctagaaagggtggaatctgagatgggtctagaaagggcagatctggggaggaaggaaccttgctggtacaagcagagtgaacagcatgggcaaaggtatggaagaaggatcacacaaaaggattacatggagatggaaggtttatgggtcctgtggagggcttgagggagaggagactgaggaagaaggtgggccaggcctggggttggtcatggcttcaggacacagggctccaggactgaaccaagctgggccgtgatgtggggcaaagcatcccatgatgcacagggcggttctctgaaataggccagtgtagacatggccttgagggtaggtacgtgtgtgaacagagaccacaggggcctcccgcacccactcacgagccctgtttttatcagtctctagacacacacctgagcagccgaagcacacttgctctgaggcacgtagagggctccgtggatggccacgtccgtggttggacaaggacaagggcgaaggcttagagcagctgaagggaaacctgtcctggggagaatcccagggctagtgacggcggcatgattttcagggcacagtgcaaaatgaaaatacaggatcccttgttcaaaaatcagtaagaatttcaggacagcgaccacagaacacgaaaccaagcatgaggcccttctaagcaagggaccctgtgcaactgcccaggcctgaaaataagcctctgtctgcctttccttccttccctggacttgtgtgggcttccattctttatgaatccacagtgttaaaataataataagtgaagccttgggtgagagcatagcttgaagattttagaaccagtaagaacattagggaaaacatgactccaaccaacgtccccaccctgtctgcattttacgttgtagaacacctgaaggatctaagaaatttaaaaataagctcggtaatctcaacacccagaaaaaaccactatcattcggtgtgtttccttccagtctatttttaccccatgtcttgtttttgcctctgtgggtctctttcctccatgtgtgaggccatgcagatatgtctgagaacctcaacaagaatatcaataggctggggcatggcggctcccgcctgtaatcccaacactttgggaggctgaggcaggaggataacttgagctcaagaggtgaaggctgcagtgaactatgatcgtgccactgcactctagcttgggcgacagagcaagacctggtctccaaaaaaaaaaaccacacattaacagtcattacaggttgaacatcccttacccaagatggctgggaccagaagcattcaaatttaggacttctgattttgtcagatttcggaatagttggattatacttcagtccaaaatccaaaattctccaatgagcatttcctttgagtaccatgttggccctaaaaaagttttggattttggagcatttcagattttagatttttgaattagggataatcaacctgtataggtgttaggatatgtctaagaagaatctagaacggcaccgtcccgtaggattctctgtgatgatagtaatgtcccatgtctgtgctgcccaacacagtagccaccaggggcacgtgaatcccgagcgcttgaaacgtggctactgtaactgaggaactgaattttttatcttatttcattttaactattttcatttagatagcatttaagtattttcatttaaaagctaatggctactttgtagggctatgcagatctgtttttttttttttttcatttttcttttcttttcttttcttttttttttttttttcagacggagtctggctctgtcgcccaggctggcgtgcagtggcgcaatcgcactcactgcaagctccgcctcctgggttcacgccattctcctgcctcagcctctcgagtagctgggactacaggtgcccgccactacgcctggctaatttttgtatttttagtagagacggggtttcactgtgttagccaggatggtctcgatctcctgacctcgtgatccgcccgcctcagcctcccaaagtgatgggattgcaggcttgagccaccgcgccctgcctttttttcatttttcaactcaaaatgtttgaaaagttttatacataacaagcacgtactgctttagtaatcaaaagaaagatagtaaaaattttaagtttttaaagcattcaatgctaccggaaaaaaaaaatacctgagttttttaaaagcctatgatgggggaagattgatcctgttagaataggatctatttttacttttccagtcaacatacagaagaacgaatgtggggtttagaatcagaagctgtgggtttgtctaccggatctgccacttactggctatgtgcccacttaacctttgtgaacctcaatttcctcatctgtatgatggagacattgatgctagtgacctctccaggccgctgtgggggctgaatcagacaaggaaggtgagaacaggaggaatggcctagcgatggtgcacatgactggagatgatttctgtagaggtggagccactcatccctgcgagagggtgttcctcacagctctgactccccttgccatttcctagaaagcaggaaatgagggtggcatctcccaacgtgtgttcagatgttatcagctgttgagcagaaataatggaactctgtggtcaaacaagattgggattggttgtttcaaacaatgttcaatggtgttttgctgcaggacttgtcagagtctttgatatgctaatggctaccttgttgggccatggagatctaaaatagtgtatgctcaactgtttattgagttatctcttggggtgagatgatgcatctggaaggggctggtgtgtgcaaagtccacttttggaaaagctgctctagagagagctattggatccaccatgggctataagcactgtgggggcggggaaattatcttctcaaggacctaggaaattgtattgagatttcaaaggaaaatttgctggatcctaaatacaaaagggaaaagcacaacattgaaatgaatcaattcgtaattgacagtctagaaaatataaattatgactcaacttttaaatagttccattagcagtaaacatttacatagctcttaactctatgtcagccactgtctaagtgttttccatacctttgctcattttgtttatatatgtatttgagacaggttctggctctgtcttccaggctggagtgcagtggcataatcttgctcactaaagtctctgcctcccaggctcaagtgatataccttagctcatttaatcctcacaaccctataagacaaaagctcttatgaggcctattttacagatgagaaaactgaaccccagagagattaaggcatctgctcaggtcacccacccaggcagcctgcatccagagcctgcgtggctcgccaaagcacagtagctatgaattaatggacgtttcctcaggtcaaggagcatccttggtcttctcttggccccatttctggcaagagctggtggtgcccccacgagcttggttcccacgtcctccacccaaacctagagaggctggagcgactcaaggggtgaagggaagccaggcagaaccagctccaccaccttcttactgggtgagtcattgcctcctctgggcttcagtttcctcgtctgagaaatgggccagtaatcatttgtggaacaagagaggggagattcataaaactcagtgtatggcccatgcagaaggtacttgaggtgtggtggtcttctccttgctcagtgcatagttagagaaattgaggcacagagagagagggacagggccaaagctgagctcagagagcaccccagggagctgggccagaatcccatggcaacacatgcagggaaagagcttctttctctctctctcagcaggcacccatgctgccttatttttttttttttttttttgagatggagtctctctctgttgccagactggagtgcagtggcatgatcttggctcactgcaacctccaactccctggttcaagcaattcttctacctcagccttccgagtagctgggattacaggcacgcaccaccacaaccggctaatttttgtatttttagtagagacagggtttccccatgttatccaggagggtctcaatctcctgacctcgtgatccacccacctcagcctcccaaggtgctaggattacaggcgtgagccaccacgcccggcctatgctgcccttcttacggcagcacatcaagcactttggcagggacctctgggttcctctcccctaggctcctcagctctcctggggcccttccacctactacaggtctgcctgatccagggtcatgcccaggcctactgcccgggcatggtgcagatatgccctggtattcccgtcaggtgccctcttctgagcgaggggcaggcacacaggcatggccctgttcatggccccctgtgcttgtccaggtaccccagatactccaagcagagggaggtactccacatccctctactccaagaacagagatccaccccacgcccagccacctgtgagactgctatgttccagggctacctggcccccccacctcctgtgcttgaatttaacgctcagcagttgccatattgaaatgctggatcattttcgctctgaattagtgtgttgtaaatgaagcctgatgggctagtgcagcatgcctggggacttggggcccgggtccagtctgcctcctgctgcctccagggatgggttctcagcagcccactacctgcactgccgccctccactgaggcaggcatggggaggagaaaggggttggaatctgcacaccaagttttggggtggcccctgagcatctgtgagggtctgcactttctgcacaagtctccccaggtccaagtacgtgtgacattgaacagcaaataaaaaacaccaccgtgggttgagagtccacagaagaaaggaaaaacttttgttcctgcattttgaaaaggggtcctgtattttctttttgcactgggtcctataaagtaggtaactggccctgcctgaggattggagagacatgcaggacccccagaaatacagtgcaggcatcgggggagctcagatgagctgccctgttgagtttctgcaagtgagaggagggagcaacggctcctggggtctcctggggttccagggcccaggcaaaaagaggaggctgcagtgtgaggaccctgggacatggaagccccgcccacaggtaccctgagctcagctatgctgacccctcctggggtggccccatgctctgagccaaggcccacccttctgccaagcagggtgccaagggccaaggccaaacccccgctccagagaggcctggcccagagtggcaggccagaggtggtgggtgggctcctgacggcctccctggcccaggccgcgtggatgataggctgggtgaggtgggctgctggccttggctttcacacacatcacggggaatgaaaagctcacagaggccactgcagagtgcaggaggccaggtcacagttcagtcagtgatgaaggccagtgggggtcagtgacaacttggactagaaatcaagctgtggtcaaggttgggactcagtttgtggccgcttggggagtcaggttggggcctctctctgtctcgttcacatccgccaagtccttggtgtgggtgctgggcagggtctgagtcacaggaggtgctcagtaaatgctcctggaggaatgaataaatgagtggtctgctcacggggggcgaggcatggctggagtgcagccctggacgctggacgatttgcactttccatttagccagacttggattcaaatcttggctctgcttcttacaccctgagggggatatttaacctcctttttgctgtttcttcagccatacaatggggagaataacagtacctccctctcaggctgttagagaattcactaagacaaacctgaagtgctcagctccacagccgcccgtgggaaatgctccagtatgtgggaatgaatgtgattgtatcaagaagacctgcagacccccatcccctcaaagacactcgcagtgttcactgtggttataagacttcaggctttaacattttttatgtgttttctgtattttccaagatttttcattgtgctcatattatttgtatcacaggggcaagcagcaggaggcagggaggtgggttcgattaatgtgattaatttacagtattgtttaaatagacaatcataagaggaggtcaggcagagttggctcccctcaagcattcactggggtcccagcttcccagaggccctgacagcatttgagccctgtggcctccccacatgtacccttgtcctggatatgcccctcccccacatgcacacctgccctgcatgcacccccaatgcacccctgccatgtacaaacccttctctcccatgcacctctgtcttgcacgcaccccccacatgcaccccgtcctgcacatgaccctccccgacatgcacccatcctgcatgtacccctcctccacatgcacccctgccctgtacatggccctcccccacatgcacccctgtcctgcatgtaccccttccctgcatgtgcccaccttcaggtcagaccagcaccatctgagggtttctggtaagacctgcgggtgtgctggggcctctgtcacaggctgtcccagctcagcaaccaaagtctgtccctgccaccatgttaggcctcccgccttgtgtgcccacccccaccatgtgcatgtgaacacacaccaccctcacacaagcatacacacacttcacaggccgcacctgctgcaacagacacagacttttcaggaactccttttggggggaccaagggccacctggtggcgtggtctgagggaggctgcagggggaggatgcttaacccctacccacgctgctcttcttatctctggccaggaaatccttcctcttcctgggggtccccagacacctgccacgagctcctgtccactgggtggatgcttctggagggctgaggcctccaggaatccaggactgatgtgacagagtcagggccccagctcagaaggaggtttcccagctgggagaagcctcagtgatgtctggagggtcccattgtctgacagatggggaaactggcccgggagaaggtggggcctccccaggtcaccccaggaagaaaggtagaagcggaggaggcagcctcacctggtggaagcacacagcagagagggcagaggaagccagtcctggtcaaacttctctgggctctgggtccctcgcctggcagacaggggccactcaggccctgccagctccggctgtgatctgcggggagctccagaaggattcagggaactccaggtgaagcccacatagctctctgggttgtggggaaaggaggatgcaaacagggagcgtccccaggggcctaggttaaccccctgcaatcatttctgtcctcttcttcctgtggggttaaaaaatagcctcccatctgctggggcagggtgggccagcctccatctggggccgtcaggtccctcctagctcagccttggtcaaaggcctgcccactccaacccctcaaagaccgggcttggctgcttgtggtgagctggcccatctggcagggttctctctctctttgactcagcactgagtatctgcacccactgtgctcagagccgccacaggcctaggaggctgtctctgactccctgctctcccatttcacagacggagagggtgagctgcccagggcacatatggagaaaaaacaggcacaggacctggctgcccagcttctaggccaaagcttgtccttgtttcggggtagtgctgggactttgccccattgggtagcaggcagccaggtagcaggcagccggactactggggcagcgcctttgcacccccaggtgacaaggcctagggcccacagctctctggagcaccctcagtgttctcacctgtaagatgggagacagccatccctagcttcagggttaccgtgaggacacacagagacgcagagggtctggcacgtggtgagctccgtgggttaattattaccaagtatgatgtctacacaggcctgaggtccagaggaccctcagaccacagtgacctctgtggctattttggttggaactaagcatctgggccttagaccataacgtggagaaatagctgagtaaatgggtattttcagcgttggatggaatcagtgaggccttgggtgtagacaaggcttttctctggaggaggtggaatactgcccccggctttctgccaagctgagaagtccaggctgccagtgggagtggggctggagagcagctgtggggaggatgtggggcggtgtccggagcctctcagtgtctatactggtctcagcaaccccagtcccagaatctgtcctaaggaaggaaccagggatgcagctaagacatccacgcagggtgttccctgacagaaatctggaaaccccctaaacagcccatcacaagggaactatggtggtccatgagtagggggggaatgggctttccacaccctggcccctaccaggcttgtctagcagccacttgtcccctgccatcagggaggctttaagaaaacaggagaacacacatacacacatgttgggggatttcaaaagcaggtttaaaggaccccatactgtatgttcccaacactcaaaaaaaaaaggaaggagagaagggagggagggcggggaagagaagaagataataaatctatacatacagtaagaagagcagaaggctgaacacccagtgggaaccattgttctgggtggcaggattatggatggttttaattttcttcttcataattttattattttccaatttttctttaatgaatgtgtattatttttataatcagaaaaaaatgtgttttgttttaaggaatggggggcggttcaggattgttcttccccttttatagactctgaaactgaggcccagagtggaaacaaacagcattcgttcattcactcagccattcattcactcactcattcattcattcattcattcattctcaaatgcttctgggaacccccctaaagccagactcagtttgaagccccatgccaaagagctgaaaggggcccatctccgttctcagggaggtcacagtcagggaacgtaaaggacacaatagcaagtccttacaacgcattcagacaaggggccatggtggggaggggaaagagagggggccaagtcctcctgggagttttagagatggtctcacaaagagagaaaagtaggacagggctttgatgtatgaggaggagttcagcagtcagagaatgcggaagcacataccctgaaaaggaaccgggggctgttagagagagaggatccacagtgttcaggggaatgggtagggagataacattagaacattccatgagccaagttttcaaaggcctggaattgcctggctctgctgctcaatggttatgtgactttgaacaagttactaagcctcctgggcctcagtttcctcatctggaaaatgggctaaccacctcattgggttattgcaagaaccgagtgagttaataagtgtaaagcactcagcccgggtctggcatattgaagcggctatgaaactgtctgcttttatcatttgctatgatttacactttaccctgtaggcattctgggagccaaagagggtttttaagctagaagttaatgtgaattcatttgcttatctatttcactcattcaacagacatttattgagatcctaatacatacccaggaatggttttatgtgttggggatgaattcgccagataaaatacaagactcctaaattattttaatttcagataaacgataaataattgcaatatttggggcaactttatactaaaaaggagttcattatttatctgaaattcaatttaactgggtgttttatatttccatttgttaaatgtgacaactctatctgcgaatgtaacaccaagcaagcaaaaaatccctgccctcctgcagctgaccttctgtgagagaaaagagacaattcataagtcaagctattgtgtatcaggcactaataaatgtgctgaggaactgtcaatcaaggaagggagacatattcgtttcctatgcctgccatcataaattaacccacttttagtgccttaaaaaaaacatgcatttataatcttacagttccagggatcagaaattctctatgagtctcccttggccaagatcaaggtcagggcagggctgtgttccttgctggaggctctggtggagaatttgtttccttgtcttgtccagctcctaaaggctgtctgctttccatggctcatagccccttcctccaccttcaaagcccacagctttgagccatgtttttcccacgctgccatctctcaggttccctaatcagtttccacaccccatctccctccgactgtccttttctgcctccctattccatgtgtgaggatccttgtgatcatatggggcccacctggggaatccaggataatctcccatctgaaagtctttatccttcatcacatctgcgaagtcccttttgccatataaggtaacatagccacaggtttggggattaggatgtggacatctctgtggccattattctgcctaccacaggagaccagagaaggcctcttggaggaggcagcagggacctgaatgaagtgggtagctgagccaggcagacagaatgggaagggttttccaggtaaagggcagcacagacaaaggccctgtggtgggagtatgatgggcatatttgaaggcagggtggctggagcagggtgagggaggggcagagtggaagcagatgaggtcagagaggtggagggtggcaggtcatgtagaccccatcaagcctggctagaaggggagaatcagctctctcctgcccctcaacggcccccaagccctgcccctgaagtaccaccctgtcctgctaagctgacacccattccaggagtactcacattttaataagaaactctgtaaggccccaagggctaagtcgctaatgtttaggcccagcgatggacagtaaagagatattttatggcagagaggggcacagtctcacctcccacaacaccagggaactggtgatcttccctaacatcaaaggccaaactcttcttagagtactgcaagatgagaaggaagaggctttccctgcaaacgagggattcaggttagatgttcaaaagaacttcctgtgtgctagcagaaaactgtcagttaaggttggtaacatctgggagcctaggtcctggctgaggaccctgccctcagggggcctgacattcagggaccagcggaggtcccacgatgacctgggggaagaatgagtcctgactttggactcccctgggccccagcacgtcacatcccctctccagacctgtttttccgacacaaggggactagcctcagagatcttcgggggtcctctccgcactggccaactgttccagggctcttatttcctaagacaaaaacctggtagctgtgtgtttggcaggctacttaaccttgccgagcctcagtttccccaactgtaagtggggatgatcacagaaccccctcttaggatggagcaaggatgaagagttaagctgtgtgagttctcagaaccgtgcctggcaccgtgagcacaccatcagtgggagctactgcgatgaagattctaacatcctcagggtctcagagcctcaagtccatgaccctgtctccaggagcctcacatttgctggctgtgggattctgagtctccagacacccccctccaccctgctgccagcatgctcccaaagccctggcctcccccacgtgctgggtggcatgcctgccccacaaccacatgaaaagtcattccctcagggtgtccccacacctgggaaaaccggcagtctgcccggcgctggtcccgcctggtggctggaacaccgggcaagatcaatgacacccggctcggctcccggtgctgccaccttgttccaatcagggctgggcgccttccgctccggacccccgcccagtcctgagccgctgccccctcctagaccctacccagctgcccacatttccagcctgtgacctctcaggagcggtgcccacgggctggctccacagtggctgcagcctgcctggactggggtggttgaataacatgccaggcaatgggcaggctccgaggagcaccaggctgggaggcgggagcccgggtcaggtcctggcattagggcaccgctgatgctgaccctccccactctagcctcagtttcctgcactgcaggtcaggctacttaggctcaccccatctggctctcagggctgttgtgggagaagcaacagagagaaagggcagtaagagttttaggaactggggatactagcagtgcagaggagtggggagaaggcaggtgggtaaagccagttccactgtgcagtgggccctcctaccagcccccttctcccttcctgggtccctctcaaccctctggtctcagctcgcatgtcacctgctccgacagaccttccctgaccaccctgtctaaagtattgccaagagcccctctctccccatccacccagtcactctctctgactttacccccatctgttttcttgagtgtcccaagacactatcaaatattggcgtgcttatttatttgcctccttgtctgtcttctgtctgccctgctggaatcaaagcccccaaggagctccatggctttctggtccattgcttgtatccccagcacctaaaatagccctaggtgcctaataagtgtgtgttgactgcttcaatctagtgccaactccttttcctctgtctgtttcttacttctccttttcctttccatctcatctccccccctcatctaagctcagagctgctaagggcaggactgggaaccttttcccctgaggacacggatgggggcaggggcaagcccaggcctccgtgagctaaaagggccttcagatcatccagccaccctggatttgattaaggctcagaggtgaggcagtgagagggccccccaccccaggtctgaggacattcagtgggcttctggaagcccactcaggtgataaatgtcacattcctgccagtggaaacttatgccaacagcaaatgacagagtgcccagtgtctgagcctgtcacctggacttgccaggcagggagtccaaagcctgctctagctccgtttggctgtacccacagcctcagcacctccccagcagccatgaccctgtaaggaggcggggactcaggtcatcacacagggctagcatcactctgggagcagatctcctaggcagcatcctccaaccccagccaacccccctgctggcctctggtcccttgggatccgctgtggaccctggagccaccgttctgtcttttgtttccatgaagtctgagctccccacacagccaggccaggaaacacaatctgggatcaggctgctgaggttcaaggctcagctctgatactcacctagggtgtgaacttgaacacgttcctgaccttgctatgcctccgttgtcctactgttacaatggggatgatgataaatgtacctaatacaaaagtggctccggggattcaacagcatgtgtgagtgtacataacgctagttactataatcaaggggcctggctcctcgggtgaggttgctgcacaactttggcattgacagagctggttcaaatcccagctctgccccttcctatgtaggtgcaagggacttccttgcctgtaaagtgggcccactgacacatacctgaagggctactggtcggccatgaggagtgcttggggagcgtgctcagcaggggctgttacctagaagtgcttacctaggtgggggttgccatgatgaggacagctgcaagggcctgcagagattcaactgagagtgtgatggtacacaggaccatccggatgaaacagtgcagctttgctgcatcatgaataattgtacgatattatgcacatttgagcatattgtccattttttcagaggtttggggcaggggaactttttctatattttatcttttgctttcctttaaaatatttttaaacatgtaaaatacatgtacagaagaatgtataaaatataagtattgtttaaagaagaagaataaagcagacatctatctacctaccacctggctttaaaaaacaaagcactaatgggaccttagggctcccaccagtgtcccttccctgactgcatccctctccctactcatcacaggtggcaagtggtggggaccactctcctgatttttttttttttttttggtagatacagagtctcactttgttgcccaggctagtcttgaactctaggcctcaagtagatccccccacctcacccttccaagtagctgagattacagacacaagttaccacgcctagctatgatttttgtattaactattctcttgcttgtctgtctgcttttcaccttcaatgtcattttctatttataagagcagaaattctgggatgacctgaaagaccaacaataggggatgtgacttgctggagctcttggaaataatttgttctccccatttcatagatgaggaaactgaggtttggagagggccaaggtcatgcagatggcaaggtgggaacccagagctggtatgctctgaatcacggatgattggctcagaaatggagctctgcagtcgctctctcatttgttcaatacgtgtttgctatgagctgagcgtttgagacactagtatctggtccggcccctgccccatctaacactcgaactccctgcacaatatcctggtctcaacttgatctctacctctgaggggacgtgtccctattccaagccagctctcaatatttctattcctggtatggagcccccagcatccatatggtccctgccacctgggagctcttcatagatctgccagaggagctcttaccccccaagcctgctctcctccagggcaaagtctccagttgctttaatagttcatcatgtgacatggtttcagtgctcttccccatgctgaggcccctgggggtgtcacatggccctaacagagggggctcaggatgaagcccagagaggccatgtgttggcctagggcatctcaacctaaacccaaactcaggtctctgggcccctaggctagtgccctgcccttccacccatgctgccgtggggcaccctagctgcaaccctcccacttctcccctcccactgcctttctctggaccaggaagacaggctctccttgtccccatcgaacaatgagggagcgggttaaactcagatgctggggaatggtttggaagccccaggggggcaaaccacccagaaagtccatgcctctgaattgaggagaagcagaaacttccagagccagggttcgactcctcccagagctgctctgtagaacaaatccaaagctctgagccctgattccatgcctgcctctgtgtgtaaagatttgtccacacaatggtctgctgtttacacagctgtgatgtgggtttctgcccatgtgtgtgtccacaccactcatataatggggcctatctgtgcatctatctgcgcatctataccaataggtccatgcatgatgatgcagacagaggcatctcctaggagcatctttgcacacacctgcacttaactgtttgcacctgtggctgcactgtaacaatgctgtcctccatgagggcttgtccatgtgggtgtgagctgccagtgaatgtgtgagagactgtgcccatgagcgtgggtgctgtgtgtgagtgcacacatgtagggtatagatgtgtgtgcgtgtgtgtgtgcactctgcgtgcccagggtccagtggagacttttcccatcctagcctcctacttcatgtgcccctccagtcctggagtctggtctttcctcctcattttccagccaaattataacccctggaaaaggggcctttattacggaaacactgacacagcccaaatgcgattggggagaaaagggttgctgccatcccctggcccacttttgtctaaagagagtgtcttagttcactctgtgtcgctgtaacaaaatacctgagacgggataatttataaatagagaaatagaaacttactacacatggttctggagactgggaagtccaagatcaaggctctggcaggttccgcatctggtgaggtcctggactccctgtttccaaggcagtgtcttctggctgtgtcctccggaggacacagaacattgtgtcctgaagtcagaagggcaaagagggcctaatccattcatgagggcagagccttcaccacttaatcacttcccgaaaggccccccactgcctcttaataccatcacaatgggggtgaagttttaatgtatgacttttgggagacattcaagccatagaagaggaactttattgcctgccaaggactcttagctgtgatttccaggcctggacactgagggtgcctgacagaccacctgggctaaaggcggcgggacaagggcaagctgagctgatgctgaggccagatcctccgaaagtttgtgcagaggcaaccgggccagctgacaggagcctcagagtcaagtccacttgtcaataagcaccttctgtgacggtgggcaaatctctgatccttcctgggcctcggtttccccagctattagatgcggaaatgaacagacctgttgtagattaatatggaattctagaatgttgaagacagagaggcctcctggggctcaggtgtggtccaatgcatttatctccctgaaggggagtctgagggccagagagggaagggacttgctcaaggttacccagcaaggaacaaggaaatggctcccctggatctagcagttggctctatgagccttaggcccaggcctggttataggacatggcaatctatgggctctgttcagccccaactttcatcaagaatttggactcttttgagtttatcaaggtgccagatccaactgcttcccaaccagtgagggtggcagaggaaaactgcagcgtgaaagagtggaagaagacacaaggaaggacttccagatgtttagaatggagagctgtgggggagggggacagggtagggctccagccacattccagaccagactcaaggcagtgacctgcatggaaagagctaataaatttacaagtggcacaaacaactataaaactgagactccatccccagccctatggatccaggcccaggtccactgttgcccaggccctcggtttgacactgacttgagaaccttcacttctctggcctcagttatgccttctgttatctgggaatagagcagcctaactgtgtgtatccccatccccctgggcatggtgaagatgaaataatgcagaatgtagagctgctaagagcactcactttggagtcagggagacctgagttcaagtctaggcttccttgccatatggaagcctctctgagcctcaattttccacatctgcccaattcacaaagtcattctgaagttcatctcaggtgatataagcaaactggctagtaggcactcaagaaaccctactccccgggattgggtacatggcaggggccaggagagacgtgacaattggtgatgaggggtggatttgtggtcaggactggctatataatttggggggcccagtacaaaatgaaaacgcaggacctttgttgagcaagtattcagaagttcaaggcagtggtggcagggcattaaaacaagctcaggacccttctgagaccagggccctgtgcgactgcatgggtcacaggccagaaagccggccctgcctctgggatatctagggtggctcaaatccagttcaggtggagaagctgaggcttcccccaccacactgggggtcactccctctccccaggattgcagctgggaccatgaccgctggccctgccactgtcagtggacatcagaggcggcataaaagaccgactgttgcccacctccgtatgcccatttgtatctcatgccatgcgtacagcacatagttgatttatttccgcaaagggctgcacttttttttcttttccaagggcgatgctggaaagccatgtggcttttattgctggcaggaatgtctgaggcgttctttcaccaccacatgaaatagagccgcaatcttcatctgcgtaaggccaaagcccccagtctcctccgagccatcggcctctgagattaattaaggcttcacaaggactgacagtcatcaggacctttttggggaggtggaaaatccctaatgggcctggctgggcccagaagctgctgggtgggcagtggggagaggagggcctgcgagagaggaaggtgcggagtcagcgggaggtagctggagaggcagggggtgcagactctgtccctggcactggctgtgaccttgagtgagactcttccttcctaggcctcagttctgtcatttgagaaatggggatttggatttgatatctcagagccctttcgagtctgacattgtaaaattccgaatcctgcccacagttcttctgccaggattctaattctattccatgactgtaactctgagcatctggttttagtccacaagagtagagtgtagtgggcagcaacatgggctctggggccaggctgcctcgttggaatcctacccctgtggtttcccagtggtgccaacttggacaagttacttgagctctctaagcctcagttttctttcctgtaaaatgggagtgataactgtcgctactccctaagaatactgtgaagcaaaaatgtgtgtaaagcaacagccactcagaagagccctttctctccctgcccgccagagctgaaccccaccctgggggaagggcacatgtttcccagaagcccccttggctccaagctgcccaggtctctctcaccactccatggctcccagtagaagagtccgtgtttgatggctctgctggcaggtagctctgcacgcacctgctgctttggatggagagctctgcgctgagagcagcggtcagagtgcagacagcccctccctgatcgaggagtggggtgctggaagggctcctgagaacctgtttgaacttctcagattctgaggcccacagaggaaaagctctttactttcggagcttgggtttccccatctgtgaaatggaaagaataaaatctctgcccttcagaggcacctgagggtgagcgacaattggcggaaaactcccagcatgcggcaggtgttcaaaaaattagggcaattattagtcatagaccaatgatcaaagtcacagaccagataactgtcttccagaagtatttccctgatttacagatgacaagagcgagtagcagggagggtggtaggaaggccccaccaagtgatgggatctgaaaccagaaaccccttccctggtaaccgatggagacggtttttctgctctgcgctcccgcaaaagaagtctcttttctccgtccttgcctccctttctctctcccatcctcaaagcagagcaccctctgaccacccacctgcagaacagggtggggatgggcgtggaaggatccgaggtcatgtggacgcaagggagctggcgccccgcgggaggtggagaggaggtgggtggggaggaggggcctcgggtcacaaccaaaccctggggtcctatggaacccgcatggcatgtagaggggccttgaaagtgcacccccgcattcagatgcaaacactgaggcccagagggaaacacgtctgattagcacttcccctgggcgagaggcactgaatgtggcatcagggtgctagtgtatgaggcccaggactgggctgcagtctcctgcaaggcaaaggtcctgtccaactgcgttttgcctcgaggtgcttgctcctggccttgctggagctcattccagatcctgatcacgccctttcccctttctgggcctcagtgttcccatctgtaaactggggactactgccagtcctgcctcctcgcagactggttctgaggccaaaggagagcaggtggtgggtgcaccttgactatcacaggaccctcccgaatgaccctggcaagtccttcctgactccctgcagatttgaagagtttactgatttccaagcccagggctgcttagcaggatttaccaaacccagctccctctccccatcacaatagctctttcctctgtatctagatgctagctcttcccattactcagccactaggaggagagtgctgacatgcttggccaggtgatgcgttcatgccccacattttgaaccagagcagacttttaacccgggtctggccctctctagcctggctgacctcggacaacgttcctctttgcttacatgggcataacacctaccacatatgacgccgtggggattgaataccatgagcaatgcccatgtgcggcgcctggcacaaggtaaagcctcagcacccccagctgttactgttcttcccattttaccctcggggaccaaggctcaggggagcgtggacaccaggcaaaagtctcagaccgcacaggcagcatctgggtcctaacaccctcaccaccctgctctcccttgctccttctccctcccctccaagtctggaactttccaaaaaggaagaaagatctctgtaatttgagaagcacatttgtgctcccacacattctgaatccttccagagaggctgcccaggatagatgaccccagagctggactctctggagctggacccccggcctacaggagacaacccctcaacccagatatattgccatttttcattaacatttctcgcttatatattcagagatcattatctgaaatcaggatgcagatgagtcctagtttactcagcagcattttctttctgtttcttcaaacaatcgatcatcaatcacaatgatgcccctcccctcctagagggaatccttaatccccctcccgtgaaatggagtggttagaatgacctccattgacagaagaggaaattgaggctcagtgaggggcatgaatgtcccctttgagttctagggcactgggcaggagataggtttcaccacgggtccctctggacaggggatttagggccaggctgggagaaattttcagttctagaagagagtcctctgctctcttcgctggactaggctcctgtgtgattcgggatatggggaacagaggcctcctgggaaggaaacggggtccctggcagtgtccgctgaggcccagttgctactcaggaaagggtctgcccacaggagggcggccggctgggggcgaaagtgaggttctgagaggaatggtcagacaggcaatcatcgagacccagctctggccgccctgtgatggttgctggaaaccccgctatgagctgactccacgtggaggtaggtcacagccagtccttacctcccccaggcagcctgtgggcgaattgagggatcaggacagcatggactggcttggagtcctagtaagctttgaatatgagaactggacatttcacagatggaagtgtgaggcccagagagaggaggggtgggtcaaaggcccccagcaaggattgagaggtcttattttttcatgacagtgatggctcccggaggctggagcaccctccatgtgccaggcctgtgctaagcactttacacacaattctatgaagggccactatgagtgccccactttacaaatgaaagaaatgaggctcagagaggtttaggcaactttccctagagcgctgtgggtgagggaaaaagacacgctcaggcagagggactgtggaccccagctccttccatagcccatggacctcttaggcggtttcccagggcacacctgccccttgtctggtatacctggggatccctgcccaggcgccacagagtccacatgaatcacacctgccctgggaaggcggcaccctcactgccaagaacgcacttagagagcactcctaaatgccagagggagacgaatccccttcctggggcaaaggagctggctctatttgcccggggatgggttctgggtttacccagctctaagtcaaggtagggtaggggagtgtcctgaccttctgcttcctagccctgctgtggacaacttagggtgctcttaggtgggggccactggggagaaactggcctgtttgtccatcgatctgatggaagagggagaaaagacgacggtccatgccaactggggaagggcgagggtgtctgcatgccccaggtgggggagtcggagttctccctcccatcaaacagacgacaatttttgtcggtccgggatggggaggaagcaggtggaaattgggaacaagctagcctgttctgtgggtcttccccgggtgcctgaaaacgcgaagacagaaggcgtccatcttatcagaggtgaggaaggcggccttggtttgacacaaagccatcggtttgtctgagacctggccgcatggatggcaaggaaagggcagctcctcgggggcggtcgccgcgcctgcacccggggccgcagctggcgcgcatctgtagcccggccgggcccgcacctccgcggctggcagggcgcgggcgccaactagcggcggctcccgccactgtgcctgccaggcggccccgcgaccttggtctggggacccaagggcctgcacccgccccccctccccccgccgccctggtcccttggatctggtgcccacggggagccagcgccctacggagagccggagccgtgccgggccctgcgccaggtgccagggcccacaagagtccctcattctctggaaacttgtctgtgaacccatcgtaagcggagagggagaaatcaggcggaggaacaagcaaagggcacggtgcaaaccgaaaccattcgacaaatggaatttaccaccacctgaaacagcgggtcatggtcccgcaacctgctcgagggcagcacgtgttgcccgcccccggccagggccctacctggccacgacgcgctgcgccttctcggagacgttcccggaggtgggagcgcccaggctggatcactcgctttcctctagttctgctgctcgtgccagcgcgtccgagggcgcgcgggcctgggtccgcaatcgacaactgccaggcgcaggctctcttaaaaggttcagtaagggacctttgccgtccttcctttcgacacggcctgagggcgtgatgtgaggtcccgaggtgggtaggggccagctctcccggtggtcggggtgaggccagagtccttcgcccctggagcgcacgcggggcttgatttcgtttggcaacgacgaaatggcgcgcgctgagcaggggtcagatccatgatgagatcttgcggccaccgtcggatcctaagcttctttgcttccgaggcttggaattcattgttttgcacctgtcgagagccggaggcaacgaaaatctagccccgtctccaaagcggcggggaggctcagcacgcgttcgttccccagagtctagggaggtgtctggggcgataattcggaatgattgtggcttgatctttcccgttgccctcccaactgtagccggcccctaggtctgctcgacagacttaggaggcgggagaggaaggggtgatttgcagtgaagcccaggagaggttgggccacgcggctgggagtgggagcggggacccggagccgggcgggcaggcagtgccttggcgaagctgtccgcggtccctgcggcgcagccggagcgcacgggcccaagaagaagtggggttggacccgcagaggccactttccacccgcatggagaaagaaaattctctcctctgaaagcgagggcccttagctttgcagccactgctgtttttcttttgccaccgacgcgcgtaccgtttcacgatgcaggaccgtggttacatgcgtaaaggaaaaaaagaaaaacgcattttgcaggcctcgtcgtgtttttcaaagagccacaggccgccacaacgaagaacgacgccgcgaggcctgcaagatcctgaaacttgttttgaggggagagcagagaggaaaggggttgttggccccaggctacttagggtccctaggagactcccttccgcctgtccccggtttggcacaggggccaccgaggctgggaccaaagccgcgcagggctgggagcagcaaaggccgccggccgggcgtggacgacgcgcaaaatcccgtgtggggtggaggctcttgggtcagaataatgtgcgggacgagggaggtgagtaacctctttggggcggctcccagtgcggcgtcaccggccctgagaccccgcggcccccagcccggggttgcagaagtcacaggcccgaagcagcaagagctggggaagcccggccgcggccagcggggaggaggagcgaaggggttgcgccccagcgtcagggagctacgacccgagagagggcggcaagggcgccttccgtgggacccggacgttctaagcaaatttctagcatttgccccgggctcccagagctctcgggggccctgggctgtggcactggggcctcctccgcggggtggcgccttccgcccctccccgttgggcggcctccggcaggccccgttcctccccgcgaacgccaccgaggtgcccgcgatgggggctccgccgattggctgtgcgacgcgtcgctccgccagccccgccccgcgggccccgggggtactaaccccgcgcgggcggccgcggccccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccttgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtgagtgcgggacccggggcgggagggcgccggccctggggctccgggcgtctgagctgcgggagccagagcctcgggagcagtggggatgggaggtgcccgagacgccgcggcgacacccgggcacccggttcagtctggctgcgcgctcggctccgggacctcggcgttccgttttggatgcgccctgcaggaatgacttttaacggggttgccccgctccacctgggttttggggcgccttgcgtagagacgttggtgcggaaatgggcggatggggttttgcgcccccctaacccggatcgctcagatacagccctgcgggtaacggagaagaggatcccgggacaggggcaaggacaccgcgggtggggtgcgaacggtgaaagggcctaccctccgcctccagcacccctcctcccgcgccgcttcgcaaaagcttcctgctcacaccctcgggcttccgaaattttaccggacggcgctaggccgggatcggggcactgctctccagacgtttgctcggggatattatgcgtcccgaatggcgagttgagattgggggacccctaaccctggcagcccccagccatttagaggacctttttctttatgccagggagtaggcgactgtttcattttcatttttttaagggggcagcgagatgaaacgaaaacgcctcggttttcccctaaacctctcacagctgccgtgagaaaagggcagggcaggaagggccggcggctgggggtggtgctgcccgaggtggctggaagctgaggccgtccctgctcccattaagacgactctaaatgggaaaaaaaggaagagtggctctttgaggtctcccgggtgacatcttaaaataccagtgggggaaatctcgccgggaggggcgggaggcccgtgtgactttaatcgtcagatcggaggttttactgtcacttggagcttaaaaggagtctttgaaattaaaagaagacaggatgttgacaggaaatctggtcttcttaatcagatcccaaacattttctccttgaaatttttaccatatggatccccagtccctgcacgcggcggccacgtttaaatagttgtgactctgtttaaagtctgattctttttcaaaaggcatccgcctctccgtgctcctgggggtgggggatttgggggagatggtgtttagggggacatcgccacccccatcctgcaattcccggcaggtgcatccttccattatcaaaagccccactctcactttaaaggggttttctggtggcctttttcaaaacaccagtgagttttgcattctgcattttctctgcataacgaatttaggctctgcagaggccaataaactgggcctggtccacatttcagggccaaatttcatgccctaaacagctcttgcataaattgagtgggggtagcagccctgttgttattattgttgttactctttctcatttggagacttcgttgctaggagcatgttgattcctctttcgctgcagccgaagacaacaggggaactgcaccccacatcatagtgactgagctgattcacagctctggcttagatttcattgaaaggatgatttcttgggacacagtttatgtaagcagttgatctaggattttggtgtggaagctcgagattccatcttcttgttttcgtgatatttgggggaaggtctttattgtttttaagcctcttctccaccctgcattggagaaatactcagtgtgcctgggacctgggggagctgcccagcccagcccctcccctcctttccctggtcaccctcttcctttctaagctgtccccctgcatccccccgccccgtgtcttcaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgaggtaagtggaagggaggcctcgccatttcagcattggcaatggcaggggcagcagggaaggaggttgaaagaggggccttagaatcccgaaaaacaggtctccagatgcagctctgtctaaaaacagcaatttgtaatcctgtaggatattacagatcgctttgaggaggtgaggaaagttatggtctcttgccagaaaaagacaattttctcccagtttctagggtttaccaactcctgaaaccgttcatgccaccccctctttcccggttaagcacacctggtctcacaaaaaatgctggcaggagatggtggattaacaagctcaaaaagggagcttataggtctttcagcaaggcggttgcaggacaagtccctgatctgtggggcccaagcaccccagccactctctccatagggggcagaatatcccccacactctgaggctgtctctccagctgtggtctcccagacccagtttcccagcgcctttgagccctaggtggtctagaacggaagctaacgcagctgaatgttggaaagcacagctcgaaggctgccatctcctgccccagagtcaaggcgggtgtgccaccctgcctgtctgaccgaccttgagcagcagaaggaaggcgggacgggggtggggggctgttgaatgggaggcttctgggacctgaaacccatcatcacttaactcctggatgggaaagtcctggaaaccctgcccctgtggaacggaggcctgagggtccactggccctttaagaccagcctgcctacgagaagtggctgaagtgggagtcgcccttcccaagcaccaggcccgcctctagctttgttaagaagtaagctgggttccctctgctccccaactccacagcaggctgaagtggctgaagcagaaccgtgcttttcatcaccaataaacaggaccttctcaaggttctagttccctctgagctgccagccccgctctgaaacaggcatctgggcaccattttttcctttccagccgttcgatgtatacatacaaatgtcagccatattttgacttttcagcattaattaaaaccaggacattatttgcatgtaataactgtttacttgttactttttatgaaactgaaatagtttacattctttcaaacatttcctgttcctgttggctcccttccccacacacagatttctttcaaacggtgcccttaactggttgcaggttgatggatggaaaatgtttgcttttatgaattaagctttcattgctgctcctaattagtctccaagtcccttttgtcatccccaatctctcaaaccctttgcgacttaatcccaaccctgagaggacagtcactggtccttggtcggtggcagacaaggctgatgagctctgctgactgcggggcagtggccaggtctgctagcccaggtatgtgtcaggagcactatagctgctgcctgttgcgaggcgggcagaaggtgctgtcgatctgggagcccagcaaggcatcaggaacttgattctcccttcccactctctctcctgggaagcgagagaaagagaagagacgacgattttctgagttaccgagaccttgtctggccattctgcacactgagaatgatttttttaggggttttcatgcccacagaccttgagcccccctccccaggcctgcagggagggaaatgggtttccaaggcgttggttgggagcttgtccttgtagcaggaatggccgaggctgggactgtggctctgggagatgcaagaggctgagtttataaaccattctctcatccatctcctctcagaggtccataaccagtctcagtggtcctgggaggcaggaagtgatctgaggaggagttccgatgtctgaggaactgtggctaaggcgttcagccttcagaggctcgaggtctttgagagcctgcattctagtatcagccaccctgcgtttgagtcccagctctgctaatgacttgctggatgacattgggcaaatgacttaaccactctgtgcctcagtttcctcatctgtgagatggggatgataatggtacctacctcatgagattttgggaaggttagggaaattgacacaagtgtatcagctggcgcatattgagagctggatacatgttagagattttgttacttcaaatgcctgggactggaggaggactttgaggtccctttgagcggtgacagccactgattctctgattactgtgtggtttgggcgggggtgggggaaacccagaaggtgtgaactgctgagtgggagaggtggaggcggttggcagggaggaaggagggtgccgggtccgctggcatgcagacacacatctgcagtgcccatcctgctgactgggaaattcccacctgagagaacagtcagtggttgacagtgacaatctgggccactttaggagatgggacactttgggagttaagactgggggttgggacccagaacccttgcctgggtctcttgacttctgccagaactaagaagtctgatggaaacctctgcttgttgcctcaatttttagttctacattctgtctgaattccaggaagatggctttccatgaaagacatgcacccagtaacaccacagagctcttaacaatagggctgaaggtgtgaaccaagaaaaggaagggaggaaaaccaggtcattgctgtctcctgcagtgattagggctgaggtccctgccctgccagacatgaggagcctttcttacaatacatattttatatcaagccttactattctacgttgaaatgtataaataatgaaacctacctatttacatgcagttgcaaactatgttattccatagctatgatggagaaaaaaagggaaagtaatttataataaaacactgatttgaatatgtaaacgttggggccacaggactccatgaggtggacgaatgccctccatgcagaagcccacagcagagggaacaggcagggtggcagggctcaatctgaacctggccttgctgccaataccatgactttctgaagttgtcaacacctgttggcaaagcgctgaacaaaattaaaaaaaaaaaaagaactgtctttccttctggaaaattcagtagatattaaaagtacaaaaaaaaacccttgttttatgtaaaactgagttaggttcatgactcagataatttttttttcttttacttttttttgggacaaggtctcgctctgtcacccaggccagggtgcagtggtgcgatcactgcagtctcaacctcctggtctcaagcagtcctcccacctcaatagctgggactataggcatgcgccaccatgctcagctgattttttaaaattatttgttgtagagatgggggtgttgttcactgtgttgctcaggctggtcttgaactcctggactcaagcgatcctcctgcctcagcctctcaaagtgttgggattacaggcatgagccactgcgaccagccagagaacttttataagcaagtttttccctcccaggaagaattgaatcttcaccaccctgggcagcgttgggtgctggcatcccccaccacatacacgcaccccacccctaacgctggcagtgccaccccaacactatgttgaccacacgccaccacaaatcccaaaaatgcccctctagcaggcggccactggcctaagtgaaaatgaaaagcacatgagctctcgagctgtgatcaactggttaaaaagcaactgtgtgtcgacagagattcggggtgcagtgtgccggtgcaggctgaggggaaccgctggttgggggagagatgaatggcttcttggctgaagctgagaaaaccccgaggtcccctgagactgagacacgtcccctccccccacccatgcagctcctgtgggtggggcggggaccttatacacataggaacccaggcagagaatgctcaaggacttgcctgaggccctgctgccaccccggctggttgatgatgggtcctggaggagtttctggagccctaaaggaaacccatttcccagaccaagacttctcccctgcaaccagggccagccctcagagagcctgggtttacacttcctgggctcctgatggattgcaggtttgcctgggactcctgcacagagttatatctagaggctgagagagagggatggatgggtttgccactgccaggcagagagagagctgggcagggccggggtagctgaggggcactcagggagacagctttctcccacccctgctccccaggctccctgtctcccgaggtccaggactcctgcccctccctctcactcctcctcttaggccccacactcctctcctttgtacctgggaggggtggtgacaggcgtggaagctggtggaagcggccgaggagtgctggtgacctcaggggtggcatgtggtttgctacctggtatgggtgggggcttctcacttctcaggagcgggacgttagtacctgtgtgcaaaatgggagccattatctctgcccttaatttatttaacaaatgttgttgagcacctactctgtgccggatgccgtcctaggggctggagacactgcatgaacaagacaaaaacttgggcccctggggaggttataatctagtagaaggagacaaaatgagtagatggattattaaaagcatatgcattgtgagaaaattccagcaggtgcagggaatagagaaagggagtggtagggcctgtgatacttcaggttgagctgcttagcgctttttttttttttttttttttttttgccctgtgggcccctctgatagctggtgaagcccgcacacctttctcagaacaatgatatttttaaggtataaaatcaaatacaaagtattacaatagaaaccatttctattaaaacatagcaaaatactttaaaaattgtggtaaatgtgctgctttattcaatgtattaaataagatctagcattgggcctaatgacaaccatggttttgaagttgtgatgagcataaaagatatttagagcaatctgcagcaactgtaatgtgatatgtaagtatctgtgacgtctgttggtgacaaggtcacaggtacggctgataatacctctgtggtttgttgcctacgctcgtacttgagagtgatgctaaatttcagttagaggttagggacaatacaattgtaattttttcctaccctagttctcaggctcattcaactctacggagccaagttaaaaatgccttccaggtgtagtggtttacgactgtaatcccaacactttgggaggccaaggcaggaggatcacttgagcccaggagttcaagaccagcctgggcacatagtaaaagcttgaaaaaaaaaaaaaagaaagaaaggaaagaaagaaaagaaaggaaaggaaggaaggaagggagggaaggaaaagaaggaagggaaaaaaagaaatagccgggcatggtggcgctcacctgttgtcccagctactcaggaggctgagacaggaggatcacttgagcccgggaggtccaggctgcagtgagctatgatcatgccactgcactccaacctgggtgacagagcaagaccttgtctcaaaaaaattaattaaaattaaaaatgcctacttcagataaagtgaccagggaaggcctgactgagaaggtgggcgacctgaaggagggttttagtaagctttcaaatgctgctgtgggcccggggccctgtggcagggcactgggacccattagtcctccgtgtctccagtctggcccctagggctctgggctgtctgcctaaactccccgtcataaccaagaaggtgctggacaatgctggcagggtcagaggctcagggaccccaggagagtgctgggctggttggaggagaaagaggtccagcagagaaatgacctcagagtgaggaaaggcagtaggaggggtcgggcagggagcccgaggcatctgcctggcacttccctagaccatctgcacttctgcttccagaaatcatacaaagtggcccctgtgacctgagagtgggagaccaggtctgttctgacctggggctccgggggcaagtgcagtcagaatttctatccctgcctcagccgactggcttaggaaaaggcttccagagaagcccctcatttcccagctggagtgacactcagtgggtcttgagctttaaattccccctggtgtctcagagggccttgggtcctgtggcatggctcctggcagcctggctggtttaattttgttccggattctcctgcctctggggctagaattttcacttgatcagttgactaacaagtacccggccatgcaaagagaactgtgagatactggtctccaccctgagcttcatctcccacctgcaacgtggggctgttgaaacctacctgctcactttggaggcgtgtcagggggacaccagagggatgcgcttgggcagcctctctccttgaccatcctgtgccagccctggggtacaggtgagagtgcgagaccattggcccctacccacagggagttcccaggcctgtacgtgggatccagaggcagggatagggggataaagtctggcttgggggatccgcaaatctcccccgctcccggccaccaatctcataaagcatgaggctgtggatcgtaatagagaatagggtgagaggaggactcttacccagacccccaaactcccagacacatcagagaattcactgtagaaagtagagagaagactgtcgaaagtaaatcttcataaactgctttctacacggagaaacccgtctgaacataaaacgatagaagaacgagaaatagaagtgaaaatgaaaaaccacccagcgtgtgaaggcaaaatgtgcaggcctgtgcccggggaaactgatggccacaaatacagcatggaaagtattaacaagcttaatatatagcaatttttaaaaggcactaaaaccttcacaggaaagtaaaagaacatgaagcagtaatttgtgttggattatgatggataataatcatataaaaagtttcattctcactagtaatagaaaaaaaggcaaacaaaatcaagagcgtgtaaaagatcttccatcttgatagacacatccctggggtgtgacgcagcctcacacgcgagggtgacgactaaatctctccggagagtcatctcactccaagagggatccgcgcccgtaatatgtcccaaccctctgctgccgtgaaatcactcaccgcttcttggaatctcttctaaggaaataagcagagatgcagacaaagatttttataaacagaaggtcactttcattttattttaaatggtaaaaaaaaaaaaaagtagtattttaaaagttttttcccctctcaggaattttgaatggagactttggagccaaatgtctatctaaaaatagaacattctggaaataacagttgtgtctacagaagaaatgtctgcagctcccaaatcagtcctttttcagctccagctgcacacatcaataagaaattagcaacgatgtaaatacccgagagtaaggaggtagataaataaaagatgaggaggcttccttgagttgaaatattttgcagccattaaaaacgaagtttatggagttttaatgacgtgggaaagtgcttctgatgtgaggttaaatgaaaaaaaaaacagtatgaaaatctgtattttagtaccactgcgactgtgtaaatatacaaacccatacaaaaagagctgaaagggaaaacaccaaatggtaacggtgtctatctccagctagtggaaccgtggggggggggtgtcttttcttctttatttatattttgtatgttcttgaatttttctacaaagatcaccaattactttcagaaaatagaatatacccatcctgctccccaccacaaaatcgtgtgggtctctgaatagaagagacagcagaaaggccaagaagaggggaacatgagccagggtggtcacggcatggggcggggggttgacaaagttggcgtcagacccccaggggccttgaatgccaagcccaagagcttgaacttcacccagagccctatcttctgcccatgttcaaagaggacagagtgccccttcttgacagttaggggcttccaggggtagatacaggtgggagagcagggtattgtggaagctccaggtgccaaccacctgcctctattccccactctccccagggaagagtttcaccctgaccatcactgtgttcaccaaccccacccaagtggcgacctaccaccgagccatcaaggtgaccgtggacggaccccgggagcccagacgtaagtgccaccgagccccctgagcccctgcgcgggggaggagggtccagtgcgggaaggacagcagctaggtcagacagatggagccctcctcggggggttgcagtccttggctctgtgcccccacacactgcgtgcctgctggcaaacccctaaaccctctgggcttagcctgagaccgtgggaggccagcgaggaggctgggagtggagatgactgtccatggagactactgagggagtcaaggaaaggaaaaggatggagaaagctttcagatatggcatttgtcgggtgcttgtgtgtttctgggtggaggttgagccaggcttgctttactctgcccccagcttctctgcgggtggctgagggatgcatggagggcaggagtgatcaaaagtcaggggctggtctggctgtgaggccaggcctcttccttggaaactgagtctttgaatcttagcatgtgacttgctcaggtcacccagagtccgggcacccagaccctatgagcagggagttctggtccatcaaagcgagtttgtgtttaattctctctgcttgctgaaggtcagattaaggctggggaagtgggagggtaggctgaggctctgtgtccacagaatgaatgaatgactgactgactgactgactgaatgaatgaatgaatgaatgaaatagagccagccagcttcctgagctccatcccacctccccaaggcattttcagcttggtgcactgaaggttggcccacccctctctttctcagaaatgtgaccctttgtagtttagaagaccttttagcagtcactattgaatgggatcttgatgacagcagagccagaggggtcacccaagttccagtgaggagagaatccaggcctgagggagttgggtacctgaataggacctaatgctgtgcaaggagcaggaaggcgccccaggcttcagtcttcccagaggcaagattctaggctgagcaggcctggggcaggaggcctggggcaggaggcctagccctgggctggcccctcccttcttgggagtcagctgggcctgacaccccatcatccaattcctgggcccatcccagcatctggccacttgggaaaggcttggagctgagtccagcagccctggaagagtttccctccagggctctcagggtcacctctgccagccctgagccccggcacgcatcctcaggcctgcaccgtcagctcccagccagcacttgccctggccacactcctgctggttccctcctgctgagatcagacatagaccagcccatgcccttggccttgggcttcatgaccctaggcaagtcatgtcttctttgtggcctcagttttgtcatctgagaactggatcagtgactccaggagtctcaaggtggtgatggctgggaagccctcatgagccatagaccaccatggtgtagagagcagtttccaagccagccttcctggctgtgggtccttgggctagtcatctccgtgcctcagtttcctgaactgaaaaatgatattcgcacaagcagctacctcatgatgctattgcgaggaaacagtggcttaatctatagaaagcacttagcggtgggggttagcaagggatccgtcactttagccagggctgttatctgcagtgtgacctagggcaagtcactgacctctctgggcctcagctccctcctccatgaagtgtgatgatgccacccaccctgcggacctggagatcaggggcgacatgtggacagcacgtggccgtagcacagaggggtcccatgagtcactgggtccgcagcgttttgtcgtcctcagtacccagcccccttcctgcactcccaccaccaccattagtcaacggtgagctctctcatgggcagcagctgggtggctgccttggtaatagaggtgcaggtatcaagtctccattgaaggaggtggcagccctgccctatgtctccaggggcagggtcagcatggacaggagcctcagttgggctctgggtggggatgcggcactcagaagccactccagaaagaggggagccactccagaaagagggaggcacgggacggggtcttgacgcttggtgggaagatccaagggaccgggcaaggttggcccctctgagagccctccatgctcagcccagcccaccccagagccgcccactctgccctgctgggacccctggatgagcatggagactcagccctgcctgtgggagattccagcagaatcccctgcctgctcttccctgcctgggtctcccagacctgagatggccccttctggggtgagctggaaggtaaatgcgtggctcaggacgaggcaacaagagggagggacagaggctgggcctggagacccacggcgtcagaagccaggcttgctgcaccacctgagacaggtgacctccctctctgggccccggcagcggctggatcagtggttttatttacagaacagagcagagatggagtcggggggcagtctactaggtcccccatccttaggacctgcctgttcctgtccctggcatatcctggccctgagatcaggtccccccccataccctgggttgcagccccactcctttgtctttggccctggacaaatccttggcctttcgggtcctcagcgtccccatctgtaagagtgaagggaccagctcagcggctcctggtcactgagcaaccccctcccttgcgtcaggccctgtgcaaagtccccagtaactgatctcttgggcaaccccaggagaggatagaggccagggcgcaaaaccttttgcccaaggtgactgtcagcacaccctgggggctccgacccgggggctgcgggaagtgagggccacttggaagggccttttcacctcagtgtgctcagctgtcaaatggatggtattggtgtctgcctaggggagtcgctgtgaaggttgactgagtttaccggggcctggccccaggaagtgcccccacaaccttcacaggttgttacaggccttttgtgctcctggacttcctttcccggcttttttcctgttttgccacctccgaccctctgaaatctgagcccgctgtggggtgaagtgggagtaggggctggtcctgggagccaaggactgggaatctgtagatccctgaggccggctgtgggttctgtggccgggtcgttcccctctggtgccctgcagagcgtgcccggcctgcagccaggtggccagctgggtttgaaggctggcttggtggcttcctgcctgtgtggcctcggtttctgaggttctcagtgctggtgtccctcagagtcactgggggctggttaagaagcaggttgctgagccaggtccaggatcccagcaggaggggcggtgacacctggcaagtctggcatggaccacggtgggggaaaggccctcacgcccccctagcctgtgcccgttaccccctgccctccctcccacatcctgctctggccaccctggtatcctggctggtctttgaacttgccagggacactcctgcctcgggggcctttgcactgctcttttttctatctggaacactcctccccggacacccccagatgcatggcacactccttcacaccctaaagcctctgcacttctcagcagcccgcctgtttcaagtggcacacacacagccttcctcacctctcccccttttccttcctggctttaaggttaccccgagcacttaccactaccaccttctaaggtgctatctagtccgatagtttgtttcatttgttattcatttctcccattttgttttgttttgttttttgagatggagtcttgctctgttgcccaggctggagtgcagtggcaagatctcggctcacagcaacctccgcctcccaggttcaggagattctcttgcctcagcctccctaggagctgggattacaggcacacgccaccacacccagctaatttttgtatttttaatagagacagggtttcaccatgttggccaggctagtcttgaactcccgacctcaagtgatccgcccacctcagcctcccaaagtgctgggactacaggcgtgagccaccgcacccggccccctgttgtttatgctctacaagggcagagttctttgctctggtttgccaggccctggtatagctagaccctgagaatgtgggcaggagcccttcacagctgctccataaatcgttgatgaataagcaaatgattcattaatgtcatttcgggtagtaggaagtcctatgaagaaaaacaaagctgggagaaggagtggagcgtgcaagggatggaacaagggatggggcggggaggcctcctgaagaggtgacctttgagcaggggcctgaagtgagcagccagcagagtgtggctgccgagggtttggcgtgggcaggagaagtgaccctgagcccgcagttgggcctttgaaggccttagagtttctgtagtttcttcctgggctgaggagaggcagctgctccaggtccctggctcccaagatccccacaacccccaggagtgtctcctgcgctaggggcagggctagcggagtctgcccagcaggagggaaggggttaaccacagacctcccgggttctcctaatcaaccccaggccgctggaagccccacttgcagccctgggagggaaccgctcgcctccctgcccgctggcccccggccagcccgtttccctgcccagccaccgacccggctttcatctgctcacagggggccgattcacagcagaccaccccaggcccggcacccgcctgcgattccgcgaggctgttaagagtcgggtgtaaatctcctgacaggccgcagagccggcctcgggcccggcgccccaccctgctgctgggtagacagtggctgctgtgtctgggtcacagccgcaccaggcggccaagaaggctgccgagtggcttcagatgggtgacgggcctggtcattggagcccacactgtccccagcagacgatgctgttcctgtggccctgcccgactctgcttttcccaagaggctgaacactgagctggcctcttgccagctggaccttacggccaggtgacccagctcttctctcatggaggtcttgggaagcgatgaccttagcagctgagctccatgtgtgacctttccaggtttgaatctcaggggtgccacacaccgtgtgaccttgaccgtgtgcctccacttttccatctgtaaaacgggggtgatagtcacagcctgtcagagggatatgacccttggagacgacatgcatggccccccttgcacagtgcccggcacatcatggatgcctgctaaaatggttgccactcctatgacaggggcttgtgttgggcctgcatggaggcaagggggtaaccctgatggtctcttggttcccccagaagcatcaggtacctggcgggggtaggaccccaggctggccaggctggtggtggggaaggattccctggggacagtggtaaaggagctgccaacccagaatccagccctggtcctctagctcccacactgcgtgaccctggtgagtccccagactggctggggcccagcattcctgctcccactttggcctttatcatatgcctgtgaggtgggtcacccccactgcacagacgcatcagagaggagctgtttgcctaggagcagatggccaagtcagaatgggaacccagaacaccttcctcaaaggccaaggcctggtgggctgtgtaattcttgaaacctttcctgaccctcgggggttagaggtgtgatccccattttgcagataagacagctgaggcccagaaggcaagagtggcttgcccaagacagtgaccactggtgggtgagagctgcctggtatgagcttggggccactgggcccttgggaggggcaggctgggatctgccctcccataagtgagggtcatagacactaatccaggccatgctggaggagctgtctgatctgagcccagcagctggaggctgacagcagccaggacaggccctgagggccaacgcggggctttccccagccatctcagtcctctgcttttaaaagcatgtggcctgtcctccagctcatcggcaccctcaggggttagacagtatgataaccactttacagatgtggaaactgtggcccagaggcagagagtgacttggtggtctagagcagggtatgattggaaattgcactctcaaccctgagcttcagagcagggaagggcccctggtggagtccactgagaccttctcatcttcctctcccaagtcctatcctcctgggcctgcagatagcagctctgggcctggggctggacggggccctaacatctattgtggagtcccgatacatctattgatgtatcgaacccaggctggctgtgaaccccgccctcttccgccacaatagatgtgttttcacaggctctagggagagcaggtggctgtgtgtcttctgcttgaccttgagctcactggctgtccagagcctcagttttttcacccatatgataggatggtggcagacattactcaaggggatgctgccaggcgaaacaagatggtgcttgtcagctgcttagacgctgccgtggaggaagcacccagcaagcatctgctgccgttttgatgatttccactcctgctggcgactgctttaaaggacagccctagcctgcagaggtgtgatggggatctactgtgggagaaggggggcttcctggaggaggggctcctggactgggcttcacaggacagaaagcattgctggcagaggctgtcctgagctgaggctctgaagagtggggggcagagaatattcaagaaatactgggaacagcagcagcaggaagaagtggtagtgggtgggccctggggccagcagccctgccttcttttctttctggggcccctctgaccagcggctgatctttgctaccttaaatcagggactttcaaaaggaaggggcctcagtgagcagactgtgcagaggggaaactgaggcgtagcaggactgggcccaaggtgacggagtgggttagagccagagctccccacgcagctcttgctctgggtaaccgaatgaaagaggctttttctgaagaccatcttctttcctcaggcactggaacttctgtcctattcccagtgtgagagccctggccctgtggctctgagactctctggcgccctggccacgtggggccgccttggctcccctctcccctccctggcagtggctccagcgttccacagtaacaaggaagctatttccgaagtgctgttggactcccctcctccgggaagtctgccctacggagggcaagggagcatgtggtgggagcgtgggttccggggtcagattacctgacccacagcctgggtcccggaacaggcgctcagcgtcggtctcatggtgaagcctcggtggccccgtctaaacaatgggaacaaaagggaaagtgtcaggaaaagagccctgggcttggagtcgggggatccgggtgtgaatcctgccttgctgctcaggctctgtgttcctcacacgacttcagcatcctggcctccacaccccggtctccagcatggggatgatagttctgcttcctttgggcatgagcagagataaaagcgatggtcatgatggtggtgacccacgtgactggaaagtgtccacaccttaggccagcacctcaacccacaaagacagtgtgatggggacaccgcagctcggggtgggggaaaggagtgtgacttgagtgaggccaccagactgcaagtgacaggacccgtcctcgaacccaggctggctgtcaaccccgccctcttccgccaggccgcaggagtaactgtaaacactctttgtacatggtgtgactcagaaacaggggactttattctcctgtgacgaaagtaacaaggcctgaggttttgcaccagccctattggctcccttcaagcttgtggctgactaaaacacccagatcctttgcactcaggctgttgtcggatcagtctgtggtccccacgtccacccggcaggcttcatgcctgttaagattcttctgctcacttgtcccccagctcatccacatctccctgccatttccagtggcctcaggagcaaggacaacatttcctccaaggcctgttagggctgaggactcggtctggaattggaagctctggccgtactgggcctgccctcctcagggtagcagtcaggtgctttccacaaggcatctcctccccatccgctccaggccccacccatcccacttgcctcgttcacgtgacttgccccatccccatgggcatctgagtttgcagccccagctccagctaaactcgcccccagcccatgttttcccctttgttgccaagggccctgggaggcagcagtgggggcctggccagagaccaaatggtcttattcctgccaccaagtgtcccatggattcctggtctggggcctcattggaggagaaggtggggctccctggttcttggtgactggctgagcccctgtggctcccaggccccctgctttctttctgaggctcccagatacctgtttgagcttccaacagggatgcgtagggagcttgggggcctacaagtaccagaatccattgcgttcccattctgaaaatcagaaatcaggcccatgcgaggcctcgggctctgtcccctcatgccctacagtggtcgacaggcttttcccacttttcgagtccccagcaatcacttgttcaggccccaaaaagcgcagtgagttctgttttacctcccacctacatcttgcctcttctccctctgccaaactagaaaacgcacatgtcattctagacccaaggccttaggcaaaccttctcctcccccttaccccctcccacatttttttttttttttttttttgagatggaatcttgctctgtcacctaggctggagtgcagtggtgtgatcttggctcactgcaacctccgcctcccgggttcaagcgattctcctgcctcagcctcccaagtagttgggatcataggcgcccgccaccacgcccggctaatttttgtacttttagtagagacggggtttcaccatattggtcaggctggtttcaaactcctgacctcactcaggtgatccgcccgcctcggcttcccaaagcgctgggattacaggcgtagccaccatgcctagcctccatcttttctaaagggtcccaggtccaggaaatcccaccccttgttcggcgtgtggcctccaacaagcttcctcgcctctccgcagttgcagttctcttacttgtaaaagagggcctggccaccctgcctgactggcagcctcccaccaagtcacgtgaggtagaatggccgtgaccgtgttagggttgatcagccgaaccctggagtgcacagtcctccaagggagccgtcctttcctcgggtcagccctggagaagctgcagccactagggggtgcgaacagggacgttcccgggagtgttgcatgtaagggaactaaaggggaagcttgagaaggactgaaatgtgggtggagaggactgcggagtgaactgtgcctccagtggccagcaggaaagagggagagcagcgtcattctcgccatgcttgttgaatcccttccgtagcagggaggatccccagggttttatgggaactccgtcatttctgtggggctggattactgtccccattttgcagatagggaaactgagtttgagctccaaggtgtgctactaagaaagcaagttacagaatgacacacccggactgaggctgttcaagagagttccatgagaagcctactttgcgttttccattcatggaagatgaaaaatgtctggaaagaaactggtcacggtggggactctggagaggagcttagagcggtggacagagccttatctgtaatgcttttatttttgtaaatattcacgtgttgcttgtgaaatgtaaaattagtaattaaaaaagtgtgtgtggcgggggaggtccctgcaagcttgatatcactccagaagtgtccctcggcctcagcaggccgcaggagggtgggagcctggccaccttgaccctcccagcacctctgagtcctcggatgtgaggctgggattcttcctgtgtgggctctggcagatagggagtggaaaatgctggcagttttctccaggtgtgacatctcgtcccctgaccccagcttccaggcagagatggctgtctagtccctcatgcaagccccctacacctctgcccagcatcctggtggagttatttttctgcctgaggcccagagagaagaaggcatgttctggggatcccagagtgacttagggctggaaaagcctgcagtcccctcctggggccacctcccattgttcttgtagacatgggagacagtgtgcaaggcaggctgggatgctgggaggcagagggtggcagtgctcctgggttatctccctgcctcccttgggggcatgagccactttctcatgtctgttgcctcagtttcctttttttagatctagggtccttgttccgttgcccagactgggatgcagtggtacaatcagctcactgcagcctccacctcctgggctcaagtgatcctcctgcctcagtcatcccagtagctgggactacaggcttgtgccaccccacctggctaagtttttcttttttcttttttttttttaatttttgtacagacaggggtctcgatagttgcccaggctgatctcaaactcctgggttcaactgatcctcccatctcagtctcccaaagtgctgagattataggcgtaagccactgcacctggccctcagtttcctcttctgccaaacagtgtgttgtagaggtttggatcaccgtgtgtcgtagaggtttggatcaccacatgtcgtagaggtttggatcaccgcgtgtcgtagaggttcagatcaccgcgtgtcatagaggttcagatcaccgcgtgtcgtagaggttcggatcaccgcgtgtcgtagagcttcggatcaccgcgtgtcgtagaggttcggatcaccgcgtgtcatagaggtttggatcaccgcgtgtcgtagaggttcggatcaccgcgtgtcgtagaggttcggatcaccgtgtgtcgtagaggttcggatcaccgcgtgtggttgaggttcggatcaccgcgtgttgtagaggtttagatcaccgcgtgttgtagaggtttagatcaccgcgtgtggttgaggtttagatcaccgcgtgttgtagaggtttacatcacagtgtgttgtagaggtttagatcaccgcgtgttgtagaggtttacatcacagtgtgttgtagaggtttagatcaccgtgtgttgtagaggtttagatcaccgtgtgttgtagaggtttggatcaccgtgtgttgtagaggtttagatcaccgcgtgttgtagaggtttacatcacagtgtgttgtagaggtttagatcaccgcgtgttgtagaggtttagatcaccgcgtgttgtagaggtttagatcaccgcgtgttgtagaggtttggatcaccgtgtgttgtagaggtttagatatgtggggtggcacataacgaccattctctgttcagaaagtcttttgacaacctctgtgaagaggctggcggtgacctcagggttctcccagcagaggcctaaggtcagacctcaggaagaacttcccagcagagtgaggcatttctgtctccactgagactctggggaagcaacggctgatgggcttcctgtgctctgcagggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggtacggcacggagggaggggctgcagcggggtgaggtgggggtggagggcctcgatgtggtccaatctgccccagaccaaaagcctgtccgaagatcagtcactgcacccccttgttttgtagaggagctgctggtgctcattggcacctgcagacggttcctgtgggctttctgtgtgctagccatcattcgttcactcagcaaacactgacattactgacacatgcctggtgcctggccccagggatctgcataccaggagttcactgtgcctggggaaatggggttaaccccatagtgcccctattaaaattggggcatgacttgtccaaggagccgtgacagactcgcccctgccatgtacagtttccccacccctgccccacagcctgcgatttttcatctgaaagtggattggggcggatgcctccacccagggctgggatgacattcaaatgacattactgtactcacacaaactttgcacactgttaagtgacattccaaccctagagaggcacatagcattcctgggaaaggtctcccaccctgcccagagcatcctcccaaacaggaggagctgaggtggaagggaagaccgagctggggtctccatctccactgcctagacggatacagcaagcacagttgcagccaggcctcaggcaggtcttctggagtatcgaggtgcctggcgcatagtagccgctcactaaacggctgccggctgcatctctcctctgttctctcagtcagtgagctggggacatgggaggctgtgtgcacagccggcccttgggctaagtggggtgccaagggtgcttggtggccgggtggacagaggcaggcagctggctgccgtcacggactgtgcccattctttctcaattccccagagcctggttagaaccccttggcagatgaatgaattgagaggcctaagaggttcagagccaccctcgggtcacacagcccatctgtgaccaggtccacagtctccacagtacctgctcccaagaactttctgtacttctgaggggacagataaaggggcctggaacagggctgccaaccggtctgcctgccccacccccttttccggtgccacgctgaggtgggggccgactgggtctctctactgacattgttccaggcatagtgctgcagccaggggctggatgcaggccttcagtgtgaagagaggacccctccccttctggcctgggctcaggacttttggccttggtcctgctgagacgccaaggttgggagaagccccaggcccagcctctctgagcccaggagctagtgcatttgagactctcagctctcgagcccaggagttggaggtctgctctcaagaggtagcggaaggagccctgcacgctgtgctcacgcccacccctgccgcgtagctgcctctgcttctgctacccatgggccagcatctgtcgaggtgcagtagcctgagagccagcctttctctgccatggacagagccaggccaggggatcggggctcagcgggggagccagaatccaggaggtggggtgaacagtggcttcctgtccaccagcccccatggaaggagagcccacatctgcccatccactgctgggtgggcacagcttgggaatcaatgcctggccccacggcaggcacagctgctgcttccatcctgggctgggaggaaaggagcccagcctgtgtggggcagtggctgacttctgcttctctgcctgctccctcctgaggcctggcccagtccctcgctagccccccacagcactgggccacaggcagccaggcatctccatcctcaggcccatcccctttgggtgagagaaagggcctcggatgaccaggacagggcgagcatgaactctgcagtcagctggaccaggctaggaattcaggctctgccaggcattggctgtatgatcttagacaagtcacttaaactcagcctcagttttctcatctgtgaagtggggagaaggaggtccctgaca

SEQ ID NO: 14387 - DNA, 23174 bp, Human
atgtcattaattctcaaatgagattcgtccaagcgggaaatgcacatctagtgcagtagttttaggccagcctttttcagagcctcaggctctgcctgtcaccttgaagacatccatgtgggtcccctcagggcttctctttgccataaaaataaaatgattgctcccaccaatgtttgcgtccatgggagaggaggtaggagcagcagtacttgtcctgtgtgtgggagacacttgaagggctcagtgggaattgtcagcagcagggaacagaacaggtggtgagaagagtcattccactgagtttctgggcctttgactccctgaaacttccttctcctctatccaacctccctctccagaaaaaaaaaaaaataatttaaaaatggaatcagtgtaatcagtgaagtagctgtattccagtgaacaagcagcctgcccttgcatctgcatgcatgcagccttggcgttttctctagaaaaaagagaggttctacctcgtgcatgaatacaggtggaggccaagaccagcattaacaaaggctgtgtgtttgccatggagctcaggagggctaacagtcattttacttctgcctccgaccatcacactttgtccccagaacaaagccaagagtccttggtcaatgaaagtgtgtaaatatcctcacacttcccctagtagttcctttttaggctgtaatcatgtgctaaagaaaagaacctaacttcttaaaatctttccctttttggatgtagattgaaatttttgttttaaacacaatggccctaatgtctaaatctaatgttagtaattaatccctagtgctttaaggatcttctgtttataggcagttattttatggagctggtctctgtgagaggcacagactgccaggaggggttgagatttcctttaaccaggattcttagttctgaatggctctagtgaataacattaacaatgattctctggccgggcactcacgccggtaatcccagcactttgggaggcctagacgggtggatcacttgaggtcaggagttcaagaccagcctggccaacatggtgaaaccccgtctctactaaaaatacaaaaattagccgggcatggtggcagccgcctgtaatcccagctacttggtaggctgaggcaggagaattgcttgaacctgggaggcggaggttgcactgagcccacagtgcgccactgcactacagtctggatgacaagcaaagctcaatctcaaaacaataatttttaaagtaatgattatcttaaccattcttaaatccttctgtctagtaggaatcttattcatgggagtgtctggaaaagggacaaagagcggctattgagatttttttaaagcctggatttgggatgtctgaacagtgaataactccaaagccatttaaaaatcatctttttttctaccaccggactgagcttttcagttttaattccaaggttccaatcatatagatgtgagtcaaaccctgttgggccaaacaggatctcctttgttggcggataatttcaagtgctcacagagaccctccgtttttttttaaatacctggacttaattgtttaaactggagtccggaccaaaacatctctgacctcgggggtcttcctttggtcaggaagaggggagggagcaattggacccctttccctctgcggctgcagagtccaattttcctctggggacatttgctttttcccttggggaagacagtacggattctagttctgtggactcttttacttagctttgagacccaagcaagttaattggcttgtgcctcttattttactctaatgcaatgaataaagacagtcccagccttcgccctaagggagcaggagcacctgcgatgccccgttcccaagtcctcagggcgaatccgccaaatgtgcgagctgggcagcccacccctttcagctgctggccggaagcggaagtgggcgtccgtcgcctcgccatctcccatagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggaggcaagtgggttcatgtggtcagagtgcgtcggcggggccttttctccactttctgtacccttctctttaaacgtcgtccccagtaggagactattttttctcaagaaaatgctctcttggacctcactttccgttgttagaaggcatatcttgggatgcgcgttattggtttgtggagatcgtccctttttttcccctctgttatgtggatgcaccctagtgcctgatacacatttgagttcctatctgagtgggcttgtgcatgttttttcgtatttgtggacttaggtcttcaaggtttatttttgaaagtcaagttgttgggtcaaagcataaatgaatgtgtaattcctaggtatgaccagatccccctctatgggacttgtgcttttttgagccctcagggtgtgttttgtatgcagcaagcagcagaccttagttttcagtttacctgtagtttcttttggatgtttacatattgacatatcgtttatgaataagaactttattctccctttataatcctattacgacccactcctgccctacaaatttactgccctgcctacgacctccgaaacattagaaggagcaatccttgctgccttccaggtctcagaaagaaagctttcagcttgtcactacttacatgtttgctatgtgtttttgatagattaaagacattcccttctgtaacagctttattgacataaaatcatatatttcatctcatttaaagtgtataaatcagtggtttttagtatattgagttgtgcaaccatgactacaatctaactctagaacattttcattgccccaaaagagaatcccatactcatcagcagttactcccccatggttggcaagtttttgggctctattcttgagtttttttatgttgtcatacaccaggtcagattgatttaggtaaaaacaacactcttcatttaagaatatacagatgttctccttttccagcagtaagtcaaggcctcggcggttttggaggacaactgcagctagagtcaacttgggcctggaggactgatgaagtttgtgatatgactgtgatgctagcagagaattcattagagagactatggaaggtcctgacagaggttgaaatgcctgctattccagtaccgagagcaatagtggaggcagaaagtcttaaactgacaagggaattagtggaataactctttttgtcgtgtcggtgtcatgaggggaacagggagctcttcagtcctatttgcaaattgcattttgagagtaaggaaaactagtgtgcatgtgcctgtccaattagcaggtagacacatgtaggtagaggatccacagaggaaaaagagaccttgtgcgaggcaaaactggagatgcaaagtaaaaagatgaggagtgctgaaaggggtgtcttgtacttagaatcctagggatccagctagggcggcagtcgtcagaggttgtaatggggactgatgaggtaattgcgtcgagggggaggttcgattttcatggtgtatgagaaaacgtcgagtatctacaagcaacctttcactgttattttcagggctgggtataagtaagcaagaagagggcctgggagaagagtctgacgagcaaggggaaggtagccaaggatggagtgaaatacagggtaagtgtcttcctaagcaataattactgctaatgtttttaagtttgccactactgatagagggcttgtctgtaatatggagctggaaggctccaattgtttcagtgatgtgtgtagttgggctttggagatgaagagtaaaggaacatcgagaaggtgaaagtttacctaggggaattccagtgggtctttgctgagagatacataaaggagctgccacaggaatagtagtttgtgttgtgagaggtctaaatatggggggagtagagttgatataaggaggaaggttttaggtctttaagaacacaggctaagggagaagggggaatggagggcagaagcttgcccatagtgaaggaggcaagcccagaaaaaagagagagtagagacatggagagaaggggtgggggcttcttgtcctccagaaaagcagagaaggggtagagacacagagagaagggaccggggggttcttgcaccccagaaaagtggagaagggctagagatatggagagaagggttcaggggttcttgacccccagaaaagcggagaagggtagacacatggagagaagggggtcagggggttcttgcccccagaaaagcagtacttgccgctaagggtgaaggaccaaggcaggcatccccacgtggtcagacacctctgaaatgtgggtgaataatcaggcaggcgtccccgcatgattaaacaccaagggaagactgtcttcccgagtccatgaccggcgccggagttttgggtccatggataaaacacgtctcctgtctacgagaaaaggaaaggaactgaaattgagagaagggagagattgaagtgtggcgccaagattgaaatgagaaagaggttgagggatagtaagagaggttggagaagagagtaaaaagaggccacttacctgatttaaaattggattgatgttccttggctggtcggtctgaggacctgaggtcataggtggatctttctcacagagcaaagagcaggaggataggggattgatctcccaagggaggtccccagatctgagtcacagcaccaaatctacctctgtcgccaggctagagtgcagtggcgcaatctcggctcactgcaacctctgcctcccgggttcaagtgattctcctgcctcagcctcccaagtagctaggattacaggcatgctccaccacacccggctaatttttgtatttttagtagagacgttctttcaccatgttggccagagtggtctggatctcctgacctcgtgatgcgcccaccttggcttcccaaagtgctgggactacaggcgtgagccaccgtgcctagcctcattcctttttttaatgagacaaggtctttctctgtcacccaggctggagtgccgtggtgccctcgacctccctagctcggccttccaccttagcctcccgagtaggtaggaccacaggtgtgggccaccaagcctggctatttttttaaatttttggtagagatgagatctcactgtgttaccaggctggtctgaactcctgggttaatgtgatccacccactacagcctccctaagtgctgaggattacaggcatgagtcaccatgcctggccttcattttctattgtcaaatgatagtccattgtatggatataccacattttcatttatccgttcatcggtagatagacatttgggttgtttctcctttttggctaatatgaataatgctgctgtgaatatttctcttgggtatatacctaggagtggaatgccttgttcatgagacgaacttttatgtttaatcttctggtaaaatgctaggctgtttgccaacgtggcagcaccacttcccacttcactcccctccacaaaaaaacaagagaatttctccacatcctcatccacacttgtctttttaattacactcaccttaatgtgtgaagtggtatcttaatgtggttttgatttgcatttccctggtgtctaatgatgttcagcatcttttcatgtgcagttgacctttttatctttagaaaaatgtacattcagatcatttgcccatctttgaattgtgttttcaaaagtcagctgaggctgggcgtggtggctcacgcctgtaatcccagcactttgggaggcccaggcgggcggatcatgaggtcagcagatcaagaccatcctggctaacacggtgaaaccccgtctctactaaaaatacaaaaacatagctgggtgtggtggcacgcgtctgtagtcccagctacttgggaggctgaggcaggagaatcacctgaacctggcgaggttgcagtgagcagagatcgcaccactgcactccagcctgggaaacagaccaagagtgtctcaaaaaaaaaataaaaataaaaataaataagctggctgaattaaattcagcccgaaagttttcaggttgaaaaaatttatttttgaaatcattatgtgatactggtttttatcactttgagttgatcatacaatttttcttttgctctattaatgaagcaaattatattgattttctaatagcaagcatctcttgcattcctctggtaaacctaacttaattctgttgtactatatttcctatttattgacattttttgtttggacttattttccttagaatatctgaatctatgttgaaatttgcctataattttgtttacttaaagtggccttgtcatgtttgatatcagtatgccaatctcaaagaatattcttccttttatactcttaatcacggtaatccctttgataagttaaactgttttgtgaaattagtttaaaagtgaccatatttttttcccttgtaatattgtaaactgctgttaatagaataaccaaaggcaaacatgacattttgaaccatacacaattctggggtttgcataaaggctatattaaataaaaccttccagatacccagctcttgcctatagagtggataagttatctatacctgaaataatgcaaacattagtgacaaattacattgaagtgtagtttaagtaaccagtcttcataaatatgcctaatctctggaatattttcatccagactggaattctttcttctttgagtggcataactgactgataaagcctttgagcatggtgttttttggtgaaaacctaaataatctagttttgttttctgttttaaaagaatatctgggcagtgagttaagctgggaagacctagcaccttgctgacgggatcagtctagattcttcttttatattttttaaattgtggtaaaatacctaaagccaaatttgccattttaatcatttttaaatgtacaagtcagtggcattcattgcattcacagtgttactcaaccatcaccagctagttctttttattgtaatttctacacagttttggtaagttgtatttctgtaggaatcaatttatttcctgaaagttttgaatttgattaaagttattcatgtcttgttaatctctgcaacatttgtagttgtgtttttctccttttgtctttgaagaattttgcccgatttttttcctagtagttttcaaagaaccagtttgtagcttgagtgatactgttgttttctagttcatcatcgtattttctgctcttcccgttccagctgcttaagttaatttttaagttcacttcttttctaatataaacatataaagcttatttttttcctaaggaccagtttagctacattctacaagttgtggtacttagaactaatcaataaccatagtattatgtattttctaattcaattcttttataaaagcataagttatttggaagtgtgatgttttctgaattccaaatgtgttacttttttctgtttgcttgaaaaatatgaaaccactaatattcaaccatattttaaaactaccaaaacacccatttcatatagttcaatgtaatctcgttattaacttacaacttagttacattgtaattaagacatgtcagagaacatgtttgtataccaaatctttttctaagttttaatttttgtgggcacatagtaggtatatatatttaaggggcccatgagatgttttatataccaaatttggaaggtttaagactggctttacagtatattcaccatacagtatggtcagtttttataaacacttcatgtgtgcttcaagaatctatgtatactccatacattcagtagtgtccctcagtgtgctagattaagcatactcattgtgttgttcaaatcttcatatcctttttttcatatgatctttctattgctgagcagtgtttgaaagtcttatagtgatgatttgtgttatttatcctttaattgtgctagcttctgctttataagttttatgagactagaattttatatcttcctaattggtactttacatcctcatgtcattacctctaatagtgccttttgtctcaaaatctatgaaattaatttagcaaacaaactttattttggttaatattcacctggtatatctttcttatttttgagactcaatttttatgtgttgttgtggattttagtgcatctaatgaaataacatagagctagtttatcttaatctaccaggacagtctgtttttaaactgcagaatttagcccatctgtacacttactgttattgatacagtcagacattttttaccatcttacattttacattgtgcttttcatttgacctattttttttgtttcatttcccttatttttcttacctttggaattgagatttttttttaacctaattccattttctcttctagactgtgagttaaactcactatgtccatcctttgaattgttaccctagctattttatcatgcatacttacagtctaaacctaatcaatattgtgagtccccagtggaagaatacaaggaacatactactcaatcacctccttcccaatttatatattatttagtattaggattgagcttatttttccatgtcacgaatttggtattattaccattttatataataaaggtttgcttaattttatccattttacctttgttcattctacttaacattttgggtcttccagttcctatctcctgaagtacttttaagttacttctgtgatggtctttttggatgggtaagttgtctcaggtctttattttaaaatgcctttatttgactctccatttatttttcttaagcttttaatcatgaaaatttttaattctccacaaaagtagaatagtacagttgtctctcatatccatgggggactggttccaggacccccacatggcttccaaattccacagtcacaaattccttatataaaatagcattgtatttgcatagaacctacacacatcctcccatagatgctattttttccctcccatttactttaagtcatcactagattacttacagtacctagtacaataagtgttatgtaagtggttggtttgttttttttttgttttttttttaagagatggggtctcattctgttgctcaggctggagtacagtggtgtgatcatagctcactgcagcctgaaactcctggactcaagtaatcctcccacctcagcctccctagtagctgggaccacaggcatgcgccaccacgcctggataatttaaaatagatacatatttttgtagagacagggtgctgctttattgcccaggctagtctcaaactcctggcttcaaggcatcctcctgccccagctttccaaagtgctgggattactggtgtgagccactgtgccgggccataaatagttatgctgtattgtttaaggaataatgacaagggggaaggtctacatgttcagtacagacacaagcattcatcttttttccacatatttttgatctgtggtcgagtagccaacagatacagagggctgactgtataatgaattctcatgtccttaacacccagctttgacagttaccaatattttgcacatcttgcatcatctagcgctgagctgtccaatacagtagccactagcctcatgtggctattgaagtttaaatgctcatttcaagtattcagtagctatccgtacatgattagtggttactgtattagatactgcaaataaatattgaataatgctgggttttccccccagatttgtttttaaagcaaattccagacatcctgtcatttcatcagtatattactaactgtgcatctctagttggttcatcaccactactccattatcccacctaacaaagtctgacgttccctgattggctacagaatatctttttacatttggtttgttcaaatgagaatcttaacagggtcccaacattttttttttattttagaccccttaagtttctattgtgtctgttctcttcctcctcccttttcatttttttaatccactgatttattgaagaaataaagttatttgttcttaaaatgtcccacatcatatatggattttgctgactggtttgttttcattgcttaacctggttatctttgtatttcttataaagagtagttagatagtttgtctagcgttttaggttgataagttatttttttctcagcatactgaagacattgtcctgctttcttctgacgtccattgttgctgttgagatgtcagctatcagtctgtttttccttttataggtgacctgtgtttttcccctggctgctttggaaattatgggaaaaaatcaaataccaaggaagaaaaatctataatgaaattagatgtggatttctttttatgtattcagcttgggggcttatgatacttctagtacccaaaggttagtgtctttcactaattcaagaaaattgctaggttttcatctaatagtgcgatcaaagttctgatctggtagttaatactggcactgaatttctcatttcagtgagtttatttttcatttctaaaaattgttttttaaactaaccattttatagtatcttaatctatatccattcaaatttttattaagcttttatatattttaaaatatatctaaaagggtaatatccaaagtgttatgctttttaccacctgacacctgtgtgttagctatgtcttacacatggtacattgtgtatttgtgtttcacaatttcttaaactgtgccttcctcaatttacttagaactttgtatataagattttttctcaagacctgacttaaagttgattttccagagataggtcgatttgcttgcactagttgcttggggacaatgccacttaggaccctctttaagtgaaattattcccttgaggttgtttgaactacagaaatgaatttggactgaaatctaaaagagagcacttgtgtatacagatcctcaagagagatttgctttttattatacctgatgggtacagttccttgcttcacgctttcatatggaaattttactttctttttaaaaaactgttcactgtggattttcagtcatacctaggaatagagtgctataaagccactatgtacctaccacccagcttcaatgattgtcaccattttgccattcttattacatctgttctctcccttgcttcctttcatcattgagctttcttttccttttttttttttttttttttttttgagatggagtcttgctctgtctcccaggctgaggtgcagtggcatgacctcagctcactgcaacttctgcctcccaggttcaagcaattctcctgcctcccctcccgagtagctgggattacaggcacctgccaccacacctggctaatttttgtatttttaatagagaaagggtttcaccatgttgttcaggctggtcttgaacctcctgacctcaagcaatccacccaccttggcctcccaaagtgctgagatgacaggcgtgagccaccacaccctgccagttttgtttttctgaagcatggttttccagctttcttgaggtataattgacaaataataaaaattatatatgtttaaggtgtacaacataatgttttgatctacctgtccattctgaaatgatcatcacagtcaagctaattaacatatccatcccctcacttacttttgtaagatgcactctcttggaaaatttcaaatatacagtacatcattaactatagtcaccaagccatacatcaggtctccaaaactcagccatcttataacagcaaatacatacccattgaccaacatctccccatttcccttgccccttggtaatcacctttctaatgcttctaggagtttgacttttctagattccatgtaagtgaggtcatgcggtatttgtctatgtccgccttattttacttagcatgatgttctccaggtttccttcttttttaagactgaataacccactgtgtgtatatatatgacattttctttacgcattcagcaatcgacaaacacgttgtttccatatagcagctattataaataatgctgcaatgaatatgaggtcacagatacctctttaagatattgatttcacttcctttggttatatacccagtagcaggattgctagatcatatggtagttctatttttaatattttgaggcacctccactactgctttccataatggctgtaccaattttcacttctaacaacgatgtataagggttccctttctccacatccaacacttgttatcctttgactttttgataatatctattataacaagtgtgaggtagcagccaactatggttttgattggtacgtccctaataatgtgatgttgggcactttttcatatacctactggccatttttatttcttctttggaaaactgtctatttagatcctttacccattttttattccatttttttctatcgaactgtatgtatttcgtaaatattttaaatattgtgcagattctttctcccattccataaggttgctttttcattttgttcattatttcctttgctgtgcagaaactttttagtttgatgtagtttcacttatttttgcctttcttgcctgtgcttttggtgtcaactctttaaaaaaaaaatttgtcaaaattaatatcaaagagcttttcccctgttctagaagttttatgatctcaggtcttacatttaagtctttaatccattttgagttgatttttgtttgtagtttaaggatctaatttcactttttcacatgtggatatctagttttccttacaccatttgccgaagagactgtcctctccccattgcttattcttggcatctttgtccaagattagttgaccatacatgccagggtttatttctgggcttcctattctgttacatttgtctccgtttttatgccagtaccatactattttcattacagtacctttgtaatatatttgaaataaggaagtgtgatgcctccagtattgttcaagattgctttagctatttggagtttttgtgtttccatatgaattttaggattgttttttctatttctgtaaaaaatatcattggaatttcataggaattgcattaatttgtagatcacctttcatagtgtgacatttgacaatattgattcttccaatccatgaacactgggtggcttcccatttgtttgtgtcttctactttcaccagtgttttagaattttcagtgttgagatcatctccttggttaaatttattgtcagtattttactctttttgatattattataagtgaaattattttcatagttttttttagatagtttgttagaaatacatttaatttttgtatgttgatttttttttaccctgcattactgaatttacatgttagttttaacattttttcatggtgtctttagggttttctagatacaatatcatgtcatctacaaacataattttacttcttttccaacgtagacgccttttgttttcttgcgtaattgttctggctagaacttcagttgtatgttgaatagaagtggtgaggatgggcatctttgccttgttcccaatcttagaggaaaagctttcaattttttataattggctgtaagctgtggttttgtcacctatggcctttactggtgttgaagtactttccttctgtaactaattcgttgagggtttttatcacagaagaatgctgaattttaccaagtgctttttcttcatctattctaatgatgatatagtttttatccttcattctgttgatgtgatgtatcacattgattttgcgtatcttgaactatccttgaatttctgggataaatctcacttgatcatggtgtatggtccttttaaggtactgttgaatttggtttgctagtattttattgaggagttttgcatctattttcagtagggatattggcttgtagttttttgctcttacagtgtttgtctggctttggtatcagtgtaatgctgacctcataaaatgagtttaatgaggagtttggttgggctccttttccatttttttggaagagtttgagaaggattctttaaatgtttggtagaattcaacggtgaagccaccaagtcctgggcttttctttgatggaagatttttcctcactgatttaatctccttactcattattgatcttgtcaggttttctatttatgattcagtcttagcaggttatatatttctaggaatttattcatttcttctaggttatccaattttttggcatataatttttcattatggtctcatgatcctttatatttctgtggttatcagttgtaatgccttctctttcatttctagttttacttcagtcttgtctattttaatcttaagtagtctggctaaaggtttttgttggtttatcttttcatacaaccaacattcagtttcatcgatcttttctattgtcttcctagtctctcatttatttctgctgcgatctttattattatttccttccttgtactgactttgggcttagtttctttttccttctactgactttgggcttagctgctgctttttctagtaacttgaggtgtaacattaagctggtataagatctttcctactcacccttgctctctttggtttccatttacgtggaatgtcttttcccatctttttactttcgggctacatgcattcttaaagctatagtgagcttcttgtaggcagcatataccttaggtctttcttttttaatccagtcagccactatgtgttttgactagagaacttaatccatttacttttttgtttaaggagatagggtctctgtcacccaggctggagtgcagtggcatgatcatactcccactactctcagattcaagcaatcctcccaccctagcccaccaagtagctgggactactggcagatgccaccacacccaaataatttttttaaattgttttctgtagagatgcggtcttgctgtgttgcctaggctggtctcaaactcctgctctcaagtgatcctcctgcctcagcctcctgagtacatttatatttaaagtaattattgatgggtaagtacttactgttgcctttttgttcattcttctgtggctgttgtacagatgttttgttgctttcttcctcccttgtcttcctttgtgatttgatgactttctgtagtgatacgctttgatttctttctcttttctccataatataggttcttgctttgtggctactatgaagcttaaaacatcctgtagttttaatagtctgttttaagctgttaacagcttagctttgattgcatacaaacaatttatactcttccatttcccacattttatgtttttgatgtcacaatttacatctttctatattgtatattaacaaattattataactttttaatatttttatcttttaatcttttacactagagataagttatttagataccactgttacagtattagggtaatctggattgagtatataattacctttaccccagtgggttttataatttcatatggtttcatgttactaagtgtcctttcttttaagctgaagaatttactatttcctataaatcagctccattactgatgaagcccctcatcttttgtttgtccaaggaagtttttatctctccttcatttctgaaggccatttttggcaggtaaaacattcttggttggcagtacagtcatgcactgtgtaaagacattttggtcagtgatggtccacatatgtgacagtgctctcataacattttaatagtgctaaaaaattccaatcacctaatgacatagccagtgtaacattgtaaagcacattactcacatgtctgtcatttaaacctgctgcactgccagtcatgtaacagtagtaaatatggttatgtacagtagattatatacagtacataataatgaatagtaataagtgaccacattactggtttatatatttttatactatttattgttattttagaatgtattccttctacttactaaaaaagaaaagttaactcaaaaacaagcctcaagcagatgcttcagaagacattctagaagtcattgtcaccataggagatgtcagctccgtgcatgttattgcccctgaataccttaagtgggacacggtagaaggtgtcagacagtgatactcaagatcctaaccctatttaggcctagattaatgcgtatgtgtcttcgtttacaacaaaaaagtttaaaaagtaaaatcgggcaggcaaaaagggcctggaaggtaggctactgagttaagaagacagagtcctagctctgctataagatttgcagcactagattttgatacatatacagctaagtgtactaaatgttgttctggaatgtcacccttttattatgaaatgcaaatatgctcacctttatggtccttatgagttactccttattgttctaagtaatttcgggatattaactcagcccaaccctatgaaattggtcccattctaacaatgaggaacgtgagggtgtgatataagatattccaaactcatcttgaagatttcttagtctatactagactcagctatttctccagtgagtcctggtttctgtcacgggtaaatgatattcagagacagttttgcactttagaggctcattcctcctgagctgttagcagtcataagcctttttagtggttcaggctagaaaaaagtccaagaaaaaatgaaaaatgcatactatatttctaatttgaggatatactgtgttcttggataaggaggcaaattgtaactacactctatgtgtatgttgttaccctttagtaagaagaagcttcccagcctgctagtgttgaacatctagcaggcctagactctaatggcttctgtgttctcctctagctctgcctgcttaggactctgcccagccaggaaggaaacctacaggaggaagaatggctgcagggtggctgacaacctggtcacaggtacacaagaaatttctctatttccaaaagcacactgccattcctgaaaagaacacatctcttgcccctgacctgaagcttcacagcccaatctgagctggcttcatcttccgcagctcccaggctgcttcatgtggaagagggaatccctgggaaaggcttctgttcccacatttgttaactttctccagatattcttccatatttttgagtatgaattccatactgtagtgagtgctgtaaagaaagacttttactaggaaaattatttatcatttctcaagtatttcttgcattcctacagtatgccctgtctatactggatctgaataagacgaaaagagtcctcacaacctaactgtgcaaagatcaagccaaccatattttagaaaagctgttttgaccatgaccctgaatgagatggcccagggagtaggatttaaagagagttctgagaactcagctttaaggcaaattaagagaaggcctctgatgcatgtctgagcttccagtgccctgagtctcctctccagtcctgtcagcctcacccaccattctcctggtacattgtcaaaaatggtcattggctgagccagaatatgtatgtgatgttttagaactcagtaaccttccaggaagtggcagtggacttttcccaggaggagtgggcattgctggaccctgctcaaaaaaatctatacaaagatgtgatgctggagaactttaggaacctggcctcagtaggtaaggctggcctcatttcttcatttgtttatgtagcaaatagttcttaagcacatattatgttccagaatctgtggaaagaatagcaatacagtggttaaccccaaaatgaatggtccctgcccttgagggggcagtccagtggcttcccatgaaaatgcactgatttcattttctctatcactaatagcttaaggtaatttgcaatctgtgtctcatcttgtgtataggtttcaagggtcacttccatatagggcgtggaccatgctttttggttcttgtgaaagaaagagctcggctctgattgttttgttgttcctaaagctgcacttgactattttaataatcctttagttaaagccaaagtatggcaatcagttttgtggaatatttaattctcacacatttctcccacatccttgctttctgcgtgagcagggtatcagctctgcagacacagtctgatctccaaggtggatcaagaacagctgaagacagatgaaagaggaattttacaaggtgactgtgcaggtgagccttgggcagaacagggtgcagccttggccagtgagggttagtacatttgggaatgtcactcagtgaaggaaaagaaatctgaggccatgacatgagcttccttcctgtttcaccatctattcaatcgttcatacgttcatttggtctccgagaaagaagttttaattcctctttaaatgtaatgtctccatgaatgctttttgtttagttctccctattttccagataatactgtcttatttcccaacctccacaatcctttctaactaaaatacctcccatttctactgcttgttcctatcactggtgaatcactggttgtgtcttctttcttacatttctctacttagaagatattatttgaaaacaaatccatagggtctccctccctttttctttgatcccaaccttttctcccaataattataaaaattcctgtgctatttcagactgggaaactcaacttaaaccaaaagatacaattgctatgcagaacattcctgggggaaaaacatccaatggcataaacacggtaagacttactaggaagtattcctggtctttgtagtagaagtctgggaatctgaatgagttaaaacatcagcacccaaagcaggggtaagaattcaggcaccaggctttcaccagaaagctgtctcgggagagtttggagtttgattttcatgaaattggagaaatctgtaaacctaggttaacacttgctggctcacagagaataaccacaagtaaacatctatgtaaatatgattttagagttaagtatttagtacataattcattcattcttcactcagtattagaaaaactgtattaaagaagccctttgctgggaaggaatagagccttggacagaggagtgagcttattcaactcgaaaaagctaatagggcaaaagtcatacgcacctactgaaaatggtacacatgtcagtcatgatcatgtgcttcctatatatggcagaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaagtatggttgaaaaattgtgttttctgaggcagaaggatcacttaagtctaggagcttgaaatcagctgaggcaacacagtgagaccccatctctaccaaaaaaggaataattaggtcttgctgtgttgcccaggctggagtgcagtggtgtgatctcagctcagtgcaacctccgccttctgagttcaagtgattctcgtgtctcatcctcccaagtagctgggattacaggcaaatgccaccacgcctagctacttttttgtatttttagtagaggtggggtttcgccatgttggccaggctggttttgaactcctgatctcaagtgatctgcctgtgttggcctcccagagtgctaggattacaagtgtgagtcaccgcccccagccaaattgttttctttaaaaatctctctctctaggccaggtgcagtggtgcatgtctgggagcccaaggcgggcagatcacttgagcttaccagttcaagaccaagcccagccaatgagccgaaactccatctctacaaaaaacaaaacaaaaaaaagttagccaggtatggtattgtgtacctgtaagtcccagctactcagtaggctgaggtgagaggatcacctgagcccaggaggcagaggtagcagtgagccgaggtcatgccactgcattcctgcccgggccacagcaagaccgtgtctcagggaaaaaaaaaaaaaaaaaactctccttttttggggggcactgtaattgggtacatttaagtttactcattttatgtttctggcaaattgtgctattagtgcccatacttttcccctaataactaatgttcattaatttactacaaatgtgagctactgacctagaaataccattttctcaacctgtaaggacaaccaggagcaacttactttttctcagcgttacatcagttatactgttgcttgcaataacatccagcaggtatggtcatctttacatcccacaacttgtcctctctattgatgcctttatgagttctttcgtaagacagacgtgaatgtttgttggggaatacacccaaacattcaggctaaccacctgaagtttctaggggttcagttgtctggcgcttgtcaagatattccctctaaggtgaaaggagaattgctgcaatttgtactactaatcacaaacagcacaatgcttggtcggtttttttggtttctggaggcaccatattgacgcaatatgacaacacttggagaatttagaaaaataacacgttctcggccagacgcggtggctcacgcctgtaattccagcactttgggaggccaaggcgggcggatcacctgaggttgggagttcgagaccagcctggccaacatggagaaaccccatctctaccaaaaatacaaaattagctgggcatggtggtacatgcctgtaaccccacctacttgggaggctgaggcaggagaatcgcttgaacccgggaggcagaggttgcagtgagccgagattggaccgttgcactccagcctgggcaacaagagcgaaactccatttcaaaaaaacaaaaaacaaaaacattctg

SEQ ID NO: 14388 - DNA, 7446 bp, Human
aattatcatcagcttaatacaacaaaagtctatttctcactcacactaagacccctgtgagctgcaggactttctaggacaactgtcttccgtgccatgattctacaccccagattgctttcatcttctggttctaccagtggggcagggaagggctggggagttgcatctcatagtccccttgctggagaaacctggaagtgacccttcataccagtgctcatgttttaccagtcagcagcagggccctaggtctccatccctgcaaggggctctagagtgtagggaacagatggaatgttcacaagcaccacagcccctgccacagtgacttttttaggactggtatcgcagagtgtttacttaaggcggtggaagctaaattcttagcatgtgctggagagcaatgaaaaagatatttactttatgaattaaagctggagtcagtgtcagcccgaaggctgaaggaaaaagagcaacagatccagggagcattcacctgccctgtctccaaacaggtgaggatggggaataaagtgaaggcagtgctttggtgggaacttcaaggatagcctctggctttttccaggtttagaagctcatatgagacaggggtggaggaaaagaagaaagaagaataagaagagaaagttgaggccctggcccaagttagtgggaagggaaatccacccccattaaactctctccctggtggactgtggggtgcacacgtgaggcctgcacaggtgctggaacatggtagaggcccaggacatacttcctgtgaatgaatgattgagcggctgaatgaatgagtaccactaaaagccctcttttctattcccaaatgccacattgagcagaagggagcaatccttgctcagcaattggtagtccctttgggtgtgcaaatgagtccacagcctgcaacagcagacagtctctgccccccttagaggcgattgcagggaggtggctgaccgttgatcacacccagagctggttatgggaatttactccatggaaagactgcaaaactgcctgaaatgtgttttggcatcagctactgacacgtaaggtttcccaatcctcaactctgtcctgccagctgatgaggggaaggaaagggattacctaggggtatgggcgaccaatcctgagtccaccaactgaccacgcccatccccagccttgtgcctcacctacccccaacctcccagagggagcagctatttaaggggagcaggagtgcagaacaaacaagacggcctggggatacaactctggagtcctctgagaggtaaagagccagcgaagctgatgtcctgtcaagagcagaattcctgctcattcgctgcctttgagagtggctgtgttgtgcatgcatgtgcatgatttgatatgtatgagagggtgtgtgtgcatgagtgtgttgagtgagtatgtgagtgtagtgtaagagaggatgttggcactatcaggtaagtacgagagtgtgtgtatgtgggcataggtgtgttaacatgtatgtgtttgggaacttgtgtatgtggaaggggttagaaggcctagaagagagaggttgatgctttcattctggaggaaaatactgaggccgagcctccatgggtgccttggagactccaagccttgaatccagtgtggggatatgcaagctatgtctagcgagggacacatcctctgacctcaggaacctcccaggtagttgggaggaacctggttccaacctcccaagaactctcagtctgatgaggtacaggggaggtctcattagtgtatcatggggttctccacaggtctgagggcctgatgtgtgtgaaaccattctgcagagctgggaacgggtcaggaggtggttgtgtgtgtgtgtgtgtgtgtgtgtgtgcattgctggagggcactccttgtgtgctctgagtgtgacagaggaagtcaccctggacttaggttggatgggagagcatgtctgtgtgtctcagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggtaagagctgaccctgacctctgagcatggggggacagccccagaagggaagcactcttgtcccttagttttctctcccattgcagtgatcctctctcagggggaaaaaagaagccatttgggaggaaggagagtagcagagaggggcagagagggagggcacagaaccccatgccccatcaccagacaactcccaaatttccttccaggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcggtgaggccacctatccctccctaccctcctagactctggcccaggcagggctgggagctgcaaagacagtgccggttcctgatgggcgcagaggtctcaggatggcctggctggaaaagcagccggcatgttggaacttctgctctagactgttgcaaagtcactgggtctctgcccagggtccaagggggtgagaccacaggcaccaggcctcctggagctgtgggacaagagccccaacagggtgtctcctcacagctgctgtgtcactcatgactgttgctacaaacgtctggagaaacgtggatgtggcaccaaatttctgagctacaagtttagcaactcggggagcagaatcacctgtggtaagagtcctacctcaccatcgagtggccctcatttgtttagacagtgctggggactgtgctgggcaccaaagatagacacagagggacacagttcctgcttcaggaagctcacggttgagtgggaagccaggaaagtgaaaatccaatgtagtaaagactccagtgggaagtaaacaaacagataaggcattaacacagcctgaggcttgaggaaggctcctggaaggggtgacccctaagctgagtctgaaaggctgtgcagagagtcagggaagaggagggagcattcccagaagaggacacagcatggtcaaaggcactaaagggcactgtaagccattctgtactgcccagcagaaacatgaggaagaggagcagtgctgagccatgatgctggagacataggaaggagctaggtcaatccggccctccaggccgggctgtatttaggttttgccctaaagcaataggatgctattaagcaaaggagctacagggtcagatttgcattttagatgactcactgtggggacagggtcgatggagacaagtggaaggggggcagagaaagctattgccatcatgcaggcaagagggagtaacatcttgacataaaacaatggaggtcaggatgggaaaggtggagaaaaaatcaagatgcatttgagatggaatcagctgaactggtgactgagttgggagggatggggagagggagttgttggatggatatgtggctgcatggatggcacaactgtgataaagaccatgggagcaggtcatggtggagggtggggaggagcagttctatttccagcatgttgagtttaggggcctccagcacccagggaggggtccagcaggcagctgtctatacaaatgcagctcaggggagaattcaggactgggacacagattcagaagccagcagcagagacctgagaggtgggtgtgatcactcatttgctgtttaaaggcccagaaaggagacagagaagggatggacagagagggagaaggggaactgagcgagaaggtcaaggagtcagtaaggaaatggttagcaagggccaagtgaacagggagtcctccatgaaaagggccaacaaggctcccctggatgttgaggcagaaacgcatgagggactcaggggaagctgtttccatggagtcgggagggcaaagccagattagaccaggtgggggctgatgggaaggcaaataaagacaggaggcaaagacaacattctggagaaagtttggccctgaaggggaggagaggtgggtggcactggaaggctttgcttggtgtccccagacagctgactcatgagtgggatttggaaaaagcgtggactcctgcccatggcctgagtcctttaagatcagaaattatgtctcccatcatggcctctccatagaggcatgtatcttcagcaggcgttaggtcacaagccacatgatgccaagctgacagtggcttgcataatggggatatgtgactgtcgcataactagaattctggaagagtgcagtgccaggcttggggcagctttccagccatgtcattaagaatccagccttctcctggccttcagctatgccacgtggccagtgtctacacctgggatgtcaagagacaggctgcaggtccaccctcctggcctcatactatggaagaggctttccttttgggcatctctctttttggagggaggaaatagatcgttcccagaagcccccagcagacttccccttgttgctcattggttggaacaaggttacatgatacacaaagaccaatcactgcaaaggaaaaagggatgaccctgcctggcttacaccaatcacaatctattcccagacccccgaggctagggctttgcctcctggacacatctgttagcaagaggaagagattatggctgttaggaaggcctttgagaaagtatcccagtgcctggctgtgtctccaccaggctggaggccagcatcccaagggcaagaattctgtctccccattggtcagaaatatctggagcgcaggtgtttgtctccaactaggagcttctggaggacagggctgtgtcttctaccccagggttcccacaagaagccactgaatattaataaactcccatcttgtgtttattttcttatgatttcagcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcatgtatatgtgtgtgtgtatgcattgccctatgcactgttagcatgagaacaaacaggggtaggggttaaaaatacaggctctgagtctggtgtagtgctgtgtgcctgttgtcccagctgctcgggaggctgaggctgaagtgcaaggattgcttgagctcacagaagttcaaggccagcctgggcaacacagggagaccttatctttataaaaacaaaacaaaacaaacgaaaaaaatagcttctggagtcagactggctgtgtcaaatccccgctcccccatctcactaagccttagttctttcatctagatggagataacactggtgcctcctgcatgggcatgtttgagaattagaatgatgacaaatgaaaagctttgggtctgatatgtctgatagctgccatgactactacaagcgaaacccagacatctccctccccttccctaggcaatagcagctcctactggcctgctgggagaaagcaggaaggttggtcttaatctgggaagctgtagtccaagtcttccgcatggaatgctcttctcctgtgttgccagtctagtaaggaggaaatgtggggtgatataatgctggccaccagctggaccctgggggtgttatcccgtcaccagggttggtttcccaggtgtgcaacccctgcagtcccatagcatcctgtgtttggaagggtgccacgcctggtttaatgctgcgctgtggctatctgaaaagtcttactaatctttaatcaagagttccttcccacacttcattttgcactgggctgcccaaatttatttatttttattattttttaatagagatggggtctcgctatgttggccaggcagatctcaaactcctggcctcatgcagtgctcctgccttggcctcccaaagtgttaagattacaggcatgagccactgcacccaacccagtcacacacatagtgtagcgggtcccacctttactgggatgctacttcccctcctgctgttcagggttccgctgggaaattcccacctggaccagctacagccccacctgtttctccaataacacgcatctgggctgctgggtgtggatcccttcacaaaggcaccctgcacaggggacacaggtgggagctgagtttcccacaggagaaggcccctgcacagcccagcaagttctgcattcccccagaggagatgccttcccataatctgtcttcccagaagaagcaccttttctaattctgcaccaaatgtttcatttgctgaaggcggccctggtcatgttcactttcacacatagcaagagaaatgcacattaaaattccactgagatgccatttttatctattacaatgaaaaaaatccagaagtgtgacaacttgatctactagcgaggctgcatggggaaacaggcactttcataggtagctggtgggagggcaaaatgcccacagagggcaaattggcaatatctatcaaaattacaaatgtatttatcctttcactcagtgaccccatttggaaatttaccctatggatgcaggcacacaccacacacccgcacacacacgtgtgcacacacagagtgatgtatgagcaaatttgttcactgcagcattgttctgaattgagctggaaataatccaagagtatgtgtcacgagaactagttaaataaataatgataccaactcaaaaagggacccaatgcatttatattatgagggaagctctctctgctccaatggacaaaggtcttcaggatatggtggtaacagaaaagagcaaagaggagaatagtataaacagtgtgccacaattatgtagcaaaatacatctgttaatatatttgtgttaatatttccagtaacactcaaagatcatgcaagaaattcatcaaaatggctatctttaggggacaaggctggcaagaaatgagtctggcacagatggggtgacagaaagattttttgatacataactttttatattgttttga

SEQ ID NO: 14389 - DNA, 94095 bp, Human
  misc_feature (1)...(94095): n = A,T,C or G
ggcaggagaaaaaacttagtatctaactgcatagacagttcattatcttaaataagttgtttctgtgttttgtgtccttttgcttttttttttttctctaaaataacatttcctagtgaacaaccaaagtagccttttttatgaagccaagggttgtatcaggttccttatttcttagttatttaagttatttagttatttaagtcttatttctaagttatttatttaatgaggattattacatgtccctggccaaaggttacttagtgtgtatgtgaagtgattcctacttgctttagattattttactactcaaaggtatttagaagggatgaaagaacaagtgatggtttaaaatctttacatattttctgactgtatttcattgttcccttctattttttgtttgttcatgaagagataaatactggaatgtggtttgtactcttagggaatgtaggtcatgcatcatttaatgacggtgatttgttctgagaaatgcatcattaggcaatttcttccttgtgcaaacaaaagagtatttgcacaaacctagatgttctagcctactacacacctaggctgtatagtgtagcctactgctcttaggctgcaaacctgtacagcatgttgctatactgaatagtaggcagttgtaacataatggtaagtatttgtgtatctaaatataactaaacatagaaaaggtatagtaaaaatactatataaaagatttaaaatggtacactgtatagggcacttaccatgaatggagactgcaggacttgaagttgttctagatgagtggtgagtgaatgtaaaagcctaggacattactgtgtgctggtgtggattttataaacattagggcacactacatttattttaaaatgtgtactttctctaataatgaattaatcttagcttaccttaatctttttacttgataagctttttaattttttaactttttgacttttataataatatttagcttaaaacacactgtatagctatgcaaaaatatttctttttcctttttctttttctttttctttttttttttttttttgagatagaatctcactctgttacccaggctagagtgcagtggtgcaatcatagctcactgcagcctcagcctcctggactcaagtgatcttcccacctcagccacctgatagctgggactacagttgcatgtcaccatgcccagctaattttttaaaattttttttctagagattaggtcttactacatcgcccaggctggtctcaaactcttggcctcccaaagtactgggattataggtgtgagccaccatccctggccttgtttctttatatccttattctatatgcttttttctatttttaaaattatttatctttttacttgttaaggatttttcttaaaaactaagacacaaacatatattagcctaggcctatacacggtcaagatcatcaacatcactgtcttctacttccagatcttgtctcattggaaggtcttccggggcaataatatgcatagagctgtcactctattataacagtgccttcctctggaataattcctgaaggacttgcttgaggctgttttacagttaactttttttaataaatagaaggaatatactctagtgatttaaaagtatagtacagtagatacataagccagtaacgtagttatttcttgttactatgaaatattatgtgttatacttgattgtatgtgctatacttttaaatgactggcagcacagtaggtttgtttacactaccattaacacatacatgtgaataatgcattgtgctgccacatgaggatagttacagtgtcattaggcaataggaacctttcagcttcattatagccttatgggctataatgttgtatatgcagttgtatatgcagtttgttattgatcgaaacatcgttatgcaatgcatgactgtatataatgccctacaaacagtgtctgcctatattcctctttctagaatcctggaagcctactgatactgaaggtaagaagcagtatgacagggagtttctgctggacttccagttcatgcctgcctgtatacaaaaaccagagggcctgcctcctatcagtgatgtggttcttgacaaggtaagctgcgtactcagagaaaactagttctttttggtgggaactgattttaactataagagcaaatatgtgaagtatgagcagtttttagtaattgttagaccaaatgatgtaaaaatatctaatgtttaagaatttgtttccctaaacactgttggattttgagtttcttataggttacagtcattttgggatttggcccatgttggagtggtggttttttttaatgtttattgatttatctgcttattatggctgttttttggtgaaataaaaaattttgtgtttgttgggggaaacatggctaaattgatacggaggtctttcctcattgttctaaaagttcattatggaattctattggcattgaagacaggtcagaaatctaggaaggtatttggcagatcaaacataagtgagagtcaacatgattcaaataatatgtatctcaaagtttccctaatagatacctccagtgattgaattctccaatcttgtgcaaataggcatccttcctctttgcatctgatctttatggtgcacacagcaaattagtacagtcagtatttgtttactaaattaaaaggagtaaagtcagatctactaaagtaatttcatcagagctgatgattaagcttgaagtatttttgttttgtagaggaacagaaatgtaaaagtagagattaactatcttatggaatcatatctacctcttaaccgatttatgcctagtgtttcattattggaatgctaagtttgtgagagttatttatatcctactgctcaaggtcataaccaaggtctgaattttcacgcaaaaaaatttgcagcctccggcataaatgggttagtaaagatgtccagcagctgcttatccagaactcatttatactattttactttcttatagcaacaggtcttcttacttctattggtggtatctaagtcttctctcctagatacttatgtgaggacagctgaatgactgattaatggtgctaatttgaggctacttcagtacctcagaagtcaagtgttatatccaccaaattcaattatcctcttagaaaatattcctgcctgtcctgctgccttatctgtttatgactttggccactaattagttgatttctcactgatctgcttaactttatgttgtccatggtcacattacatgcttattcaaagtcagatatctcagattaacaaggcagacagtgaaattttaaatgaatcatcacctatgaaacatgtctcctctaagacttattgtccactcatagtacattctttactaaccataagtctacagcatcaaaactaaaatgagcagtagcaggattcgtataggcaagtgctctatatcctggtgaatatttttttttaattctaaaatttgaccctagtatagaggatctcaaaatatcttgtcttgtgccattcagttggtcctcagtatctagtgagccagtctgctgattatgtatagcccctacttggaaatttaaggcctaaatcattcccagcgtatcagaaaaccattgttttagcctaatggctctaagagtagcccaggagaagctgccatggatgagattggacttctgcgggttccaaagctggtgcttaccgtttcagctgatgtaacttttcagtaaaaatttttgttatcttttgtggcagggaatgctctggaacatgtattaagctttcttttgctttttcatgcagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctaccacaaaaaaaaaaaaaaaaagaaaagaaaaaaataggccaggcatgctggcgcatgcttatagtcctagtcccagctactcgggagactgaggtgagagaattacttgaccccaggaggtccaggctacagtgagccatgatcatgccactgcactccagtctgggtgacaaaacaagaacaggaagtccaggcttcagtgagccatgatcatgccactgcactccagtctgggcgacaaagcaagaccctgtctctgaaaaaatatatatacagagcgagccaaccttgataagattcctgttttgttttgaggtgtcctaaaatactggagatctctgatgacattcagctaatgatcatgtctttgtctttgtttctacagatttgcaaagtgcagagcaggcatggattgccaattctggaacagagcaaagccccaacttgccctccactggtgatgtcacacccacccatgaagagcctgcctctaggggtgcgctgaacactttgttttttgtaataatagtctctggtgttataatattttctgttacgctctttttatttactattgattgttaagtcaaaattttaacaaatgacatgtacaaaagagtgcagtattggtaaactgcagattgccattacacccccagtggcaggctctttcagcggtggaagtggcatcaccagtggagttatgctggggcactgcactgtgcaggattcggcaggctctgcctactccatgctttgtagacttgcagaaagcatggggaaagttgccaatgatgttgaatgtctcttttccccaagttagaatggcatagagagcaataaatctaacattttggaggagcttggggtttgatgtacatttgcagataaccgtgttacttcattttatgtaaggtgacactttttgtttccgcatcacctttttatttctgaaatggcaacttttgaaacctgctttgaaataagactacattgtctgaaaacaaatgtcactttgtagatatttaaattatttgattattttcctgcaaccgaacagtgatggcgtatacttgaatgcctacagtgtgttggaggctttgtaaaactaccgaaaaccacctgaatttgaagcatactgtttattgagccattaatccatcaccattttagagacctgtgtatgtgagatactctgtttctcacacatttatctattttcaggaaatactaaattaaaatttttctaaatcttgagttacctcaccagaaagtcttagaaagcagctttctagaaaccattttatacccttttttttttttttgagacagagtgtcgctctgtcgcccaggctggagcgcagtggcgtgatctccactcactgcaagccctgccacctcctaggttcacgccattctcctgccttggcctcccgagtagctgggactataggtgcctgccaccacgcccagctaatttttttttttttttttttttgtatttttagtagagacggggtttcaccgtgttagccaggatggtcttgatctcctgacctcgtgatccacccgcctcggcctcccaaagtgctgggatgacaggcgtgagccactgtgcccggcccattttataccttttttttcagtattatttccctttttaatgttgaaatttttatttgtgttactgttcattttggttttggtttatatctttgttttgccaaatatttgaaataatgttgatgctattttgaatattctgtggataatagcatctgtggttattatcatattgcccaatgttgttgatatgtgactcacaaaatgtataaatcctcttccagtgtcacttttcactaacagcttgctagtcattgtttgctaataactagttataacaaaaaggaaatattgtgagtttagaataagcaatgtctcttttaaattattgaaaatagaaaatgattttcaaaagtaactttatcacagcatataccactcctctgtatacctacgtatgtgagatcagtgagttattctggtacactcaaagtaatgtgactagaagtgagatgttatctagaatttgtagtagctccaaaaagatcaactttaattatttaatttacttttattaagcagctttgttctgtgtcagaagctagtttttaagagaaattttgatgtctcagggtaatgttgatatgttaagccttaacacaagttattcttccagcctatctcctagataacagacattctccacttaatttgcccagcttaccttggtatattgatgtagatacagatgggaatgtcataggacataaatatcaacatataaaggaacaaaaatggccaggcacagtgactcatgcctgtaatcccagcactttgggaggccaaagcgggtggattgctagagtcccggagttcaagaccagcctgggcaacatggtaaaatcctgtccctacaaaaaatacaaaaatttgccgggcatgagggcacacacctgtagtgccatctacttgagagactgaggtgggaggattgcctgagcctgggaaacagaggttggagacagaggctgcagtgagccaagattgtaccactgcactccagcctgggcaacagagtgaggctctgtctcaaaaaaacaggacagaaataatgctgtttggaaaaaagcaacagccctactctttgcagtttctgattccatacttcaaataactttttccagttctccaaattatcttataattaattatcacttaatgatattaaaatctatgaggtatgccccattattatcttaagtagccatgacttctaatataaacttttctacagctcatgcctgtaatcccagcactttgggaggctgaggtgggcagattacatgaggccaggagttcgagcccagcctggccaacatggcaaaaccgtgtgtctactaaaaatgtgaaaattagccaggcgtggtggtacatgtctgtaatcccagctactcagaagactgaggcacaagaatcgcttgaacccgggaggcggaggctgtagtgagccaagatcacgccactgcactccagcctgggtgacaaagcaagactctgtctaaaaaaaaaaacaaaaaaccaaaaactttgctgtaacagacttgctataaaatatttttaatgtatgccaatgattttaaaatgtcatatgcagctacgtagttttcaaacctaagtgtccttcactggatagtaaagtgcatatctgttggaaattaccatgaaatatcatgtctttagttatttttaaaataaaattatgggccgggcgtggtggttcacgcctgtaattccagcactttgggaggccgaggcaggtggatcgcaaggccaggagatcaagaccatcctggctaacacggtgaaaccccgtctccactaaaaatacaaaaaattagccgggtgtggtggcgggcgcctgtagtcccagctactcgggaggctgaggcaggagaatggtgtaagcccgggagcttatagtgagccgagatcgtgccactgcactccatcctgggcgaaagagcaagactccgtctcaaaaaataaaaaaaataaataaaattacttatcagttgtgttagtagtctttttgcggacatcacagaaagcactccaaaaaatatatcttaagaggagcattggacctatataagtaatttgccatttatacttattttaactaacttttgagataaactgatcaatcataaaaatcctagcagcaaagaagaatcctaggagtaaagtctttctttaaaggaacacttggttgtcttccttctttaaaaatttaggtgtatattgattctcttttctttggttatccaagtaggcagtggaatttaagattacagtctctgaataagataggaatgatgtatattaaattgcaaaacggagatgggtataatttcataatacatttttgaaaactgacagtgggtaaaaaatgcaaactttaacgtcacctgaaaaaagaaaatggctcactaatcaaccccagactttgagatttttagttttgacattgtggaccttgagcacattataccttaaagttccttaaagtactgtctttcaaagaaagaaaccaggtgtcgtttctttttgtgtagcccatacctcttagcacaggatcctagattttttgtgtgtttagtatataaatcattcatcatatgttgctacttctgaaggataccataaatttgattatctgtattaagattttcacacacaaaaagggacatgaaatgtttaaatttatgtatcagttttttaaaagttccttttgatcctttggtgttgatgataatatagtttttagggtccttttacatggtttatatcctataatcacaataatgttttcaggtagggctggcattgtatatatgagaaaacaacaaaactaagagacttgcctatagtaactttgctcatatatagcagatttggactctagattctgattcttttgtctcctaagttcactacaccacagttttccaggcattgctattccaaacagtgaattcattctcagagtgtaaatatgggcacattagagattgattaattgaacatattaagaatttgtaagtatagtagatctattaatagctagataaatatttgagaacagtgtctttatcttagttataaccagagatacaattataatttaaaattttttcttgggtgctttcacgtgggttataattttaactattttatcctggactaacaatttatcagttagcttttcaaagttttttttcctttgaagcattattgttactttctcacatctctctgttgctcatttgaaactcacacatatttgtcttgggtcaggtaaagaggtgtggaataaatcatattgccattttccagattcaaatctcaaggcatatttattcattggtgtttgcagtaggttttggtaatgggcattttctgactttgtctcctaatgtgcatctatggctcttaattggttttgacataatttcctttcattgcatccagaaacatttgttcttgacaatgtttatgtacaaatgcatggattaaattaaatatcttgtgatataattgtttacctgaggtttagccaaccatttagtaagttattaatccatataagtcaacactagaatataacttgaattataaaaatcaggcattacttgattaccacatttttctatcagaattgtttcttctgggctactatattaaagtttcagttacaatttatgttcttatagtagtactgtctggtttaacaactgttccctgttggtatttttccaatctgatgatctttatttcctttcagttataccatgtgtctcatacctctgggtttatctgacctgtttgtttttttttttaatgtttatcaaataatctgtgatatcatcagtactgtatccttagctggatgcatttgacaagattggtgtgaaattttgcagaaaccctaacttttgatcctgatgcattcttgatactaccatttctaattggggcagatggtgaagcataaaggaataattctgagaatgattgatgtgtaaaggtgtttgagcttatcagcttaggccccagactgtgttatcgcctagaaactgtctttttatgtaatgaatgacattaaagtctagacttttttctctgaagcgttaaatgaattcaaaagggcagcattggggccttaagtgagaaatgattctcatctatgtgtgctttgtatgaagtttttattctctcttgaaatctaatggctagcccttcagtgcaactcagaaagaaaaaaaaaaaaatctggtggcagtatttgcccagcactaacagaatgatatatcagaaaaagtaaaggttgtcaacatgcagcaggtctgcttgaaggtagcagagcttagtatcaacccaaatatttaaccttgaaaaattatttccaagcatttaagatagtaattatgaatattttgatacacaaaatgcaacttttaacttactctgttatctctacttagtgtgctggcagtataacatggcaacatacattggttttaacataagggtatagtgggaatccagcaggaacagagcagacaaataaaaggaagccttttttttcagggagtaatttagtttgactctcattgatgatatataacgggcttattttagtatttctgacccagcataatgagtggaatcttttatgatctacagtaaggcttagtgatgatattaaatttgcattttaccctgggattgtagaaacccagttttagcagatttgtaactatgatgatacctacctgtgaatttttgtaattattgaagtgaccagtccacagttattcaactaataaaagataagcttaaattaggactagtctttctcattagaagtaacggctttgtcaaacatctggttcaaaaaggcctcttgttcaaaagttgtagtggtggagaacattacattgatggtattctgaagttattttttttacccccaaaaaagattacctccagtttgagtacctagtacccaatctttgcatctagcattgcttggcgtagtcatcagacttgacttgaacagcacaacaaagccaataaattgtaagtactctgaatagctgtaatattcttgtcctagttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggtgagaacaaaagcatatcctaacattcttttgaaattatattgattttgttttaacttattttgctttgctaatgtttctagagataatcagtttaagactttttataacattttcctattaaaagaattattctaaaagccattatggatgccaggcaacctactgttttctcttgaaattgctttatgtgtattttttcagaatagttaccaggtctagagggttcatgtgtcatagacttatgtaattcaggcttaagttaatatttgcttttctttaaaatacatttttagattctcagtgattgagtctctttatcctatttatcctaattattacattgctttatgttccttgtcaggccttcattgccaataagctagaatttagaaactcatcttgttttgaagccttttggaataaaatttaattctttgaatctttttatgcatatcctgccctcagaactatgaggataaattgaatggatttattttattgacacaaaattaatttttatgtatcagattatataaagcctttatttatcttttgctttatacacaatgtcaattcctatccccaagttacctctgcgacttgagatgtttttgcttctaggcaccaaaactggagtctcttaaaattcacacttgtaccagagccaggcatcacagatcacatactaacttttcagcatctggattccttatatatcttttctctcaccatgaacagttaagtgtagcagttcaaagttccagctctggaggcagagtcctgactctgttaggcaggttcttaatctcaactataaaatgaagttacaaacattgagtgcctcatagggccagtgttaagattaaatgaaataaatataaaccatttggcatggttcctggagcgtggttaagtgctcagtacgatgatgtccctgagatcagagatgtgccttagatatctttttgattcagtaccatcacataacctcagagagcaggggatccccaacccctagtaccagtcagtggcctgttgggaacggggccacacagcaggaggtaagtggtggcaaaagagcattaccacctgagctccgcctcctgtcagatcagtggcagccccagattctcataggagtggaaccctattgtgaactgtacatggaagcgatctaggttgcacgctccttatgagaatctaactaatacctgatgatctgaggtggaacaattttatcctaaaaaccactttcctcttccccgctcaaccccacccccaaccctggtctgtggaaaaattatcttccacaaaaccagttcctagtgccaaaaggttgaggaccactgttagagagagtaaattctcagtaaataattgttcagtaaataagcgaacccacagagtagttaatacaaaacaaagatgaagatgaggcaatccaacaactagccatgctgtcaaactgtacttggcggtttgcttttgtttatctctttagtgattatccccaaacatttgccacagggttcctaaggacatccttcatcacattgctgagataattctctccatttcaacatatctcaaccttttttggaaaaaagaaaaaaaagtcttttttgtccttctctccaatctccgtgagaaatgcttaatgataatgggcctaaatggcttataaagatagttaaaacttcctactggatcttcatcattgacagtgaagatgtatttaaggcacttggattaatgctttactttattaaattcttactgtacctataatgaggaaatagatgttatccttttttttcatgaggaaactgaagcttcaaaagttgtcaagcgtcatgaaagatactaaatagtccagttgttataactcgtaatctgtttctgtttataacagagtcctctccgttattgtcttatttcagaaacagaataattatcttgatatgaggcagcattaattaataggttttctttagtaagtagataaaacaaatctaatggagaatttttaaaattcctttacagagccagtacaaccttcttttttcttgacactttcttttaaatatggacttgctttgttgccttcccttacgttcctactactatattaaatcagcattgtgaacgaccactgttgatgaccttattctcatcttcttgaagcatttttaggatatcattgcctcaggacatgtctgggcttctacccctaggattccctgcattctctttcttctttctcctctattacaacatttctactgatgctgcctgagtcatctacctgaaacactgatttttgtctttccattcgagctttttaacctagcattcaatatgtcattttcactcacagccagtgaaaactagtcttctgatatttccagcttgttctctcaattagcaagctagaaaatcctcattaacaattccttcctaaagtgttttctccttcataaaatatctactttattttttttcttccctttacctagctctttctgtcctttattatctggcccaattctcatttccttctttttttttttcttttaagatggagtctcgctctcgctctgtcacccagcctggagtgcagtggtgcgatcttggctcactgcagcctccgcctcccaggttcaagtgattcttctgcctcaacctcccaagtagttggtattacaggcgtgtccaccatgcctggctaactttttatatttttagtagagaccaggtttcaccgtgtaagccaggatggtctctatctcctgaactcgtgatctgcccacctcggcctcccaaagtgcggggattacaggcgtgagccaccacccccggccctcatttccttctaaaggcattcctcgactaatccagttcctctgacctcatgtacctaaactattcccctttctggtctctaatcaaccctagtacttgctttatcacttcgtttttaaatgtattgtccctgcaactagattttgattctgtagaaggcaataactgtgtttcgtgcttcatttgtacctaacacagaatttactggacatcaactagatatttagttatagcgaaatgttttttttttttttgagacagggtttcactctgtcaccaaggttaaagttcagtggctctgtcacagctcactgtagccttgacctgctgggctcaagcgatcctccctcctcagcatctcaagtatctgggactacaggcatgtgccaccatgcctggctgatttttttgtagagaccaggtctcattctgttgcccaggctggtcttgaactcctgggctcaagcggtcctcctgctttagcctcccaattgctgggattccaggtatgaactaccatgcccaggctttttttttttgaaagagggtcttaaatctattgcccaggctggagtgcagtggcacaatgatggctcgctgaagcttcaacctcctgggctcccacctcagccttccaagtagctgggactataggcatggaccactatacctggctaatttgttaatttttttttgtttttttttgtttttttttgagatggagtctcactgtgtcgccctggctggagtacagtgacgcgatctcagctcactgcaacctccgcctcctgggttcaagcgattctcctgcctcagcctcccgagtagttgggactacaggcatgccccaccatgcccggctaattttttgtatttttagtagagacggggtttcaccacattgaccaggctactctggaactccgggcctcaagtgatctgccctccttggcctcccaaagtgctgggattacaggcgtgagccactgctcctgggcctaaaaattttttagaggcagtgttgcccaaactcctggcctcctgcagtcctcctgccttggcctcccaaagtgttgggattacaggcatgagctcctgtagcttatccaataaatgattttgtgtgtgtgtgtgtgtgtgtgtgtgtgtgtgtgtgtgtaatttttctttttttggagacagggtctcactgttacccatgctggagtgcagaggcatgatctcagctcactgaaggcttgacctcccaggctcaagcgatcttcctgcctcagccccacaagtagctaggactacaggtgcttactacacacccagctaatttttgtattttttatagtgatggggtttcgccatgttgctcaggctggtctcgaaacccctgagctcaagcaatctgccctcctctgccttccaaagagctgggattataggcatgagccactgcacccggcctcatttcattctttcagcagtgtctttcacagagcagttgtttttatttttattttattttattttattttattttcattattattattttttgagacagggtctcactttgttgcccaggctggagtgcagtggcacaatcacagctcactgtaacctcagcctcccctggctcaggcagtcctccctcctaaacctcccaagtagctggaactacaggtgcgtgccaccgtgctcagctgatttttgtattttttgtagggacagggttttgccatgttgcccaggctggtcttgaactcctgggctcaaacagtgcacccaccccagcctcttaaagtgctgggattataggcatgagccaccatacctagcctgtttttaattttgataatattgaattagtcaaccttttctttcatgattgtgcttttgctgtcatatctaagaaatacttgcgtaaacccaagaaaacaacacttttctactatgttgtcttttagaagtttatagttttaggtttcacatttagctttgtgatccagtttttgttgagttttgtacaaggtgcaagataataggtcagggttctttttctcccctttcttgtggatgtccagttgttccagcaccatttgttgaaaagattatcctttctccattgaaatgttttggcatctttgttgaaaatcagttcatcgtatatgtgtgcatctatttctagactctacattcttcttcatctagctatgtgtctgtcctctggccaacaccactctgtctttatatagaaagttttgaaatctggttgtgtgaattcaattctccaactttttgtttttcttcaaaattatttaggctcttctagggttttgtgtgtgtgtgtgtgtgttcatataaattttagaatcagctccttgttttctacccaaaacaaaaaacaaaaggccctattaggatttggattatgatgatatatctgcagatcactttggggaaaactgacatcttaacaataatgaatcttctaatacaagaacatgatatatatcttcatttatttaagccctctttgatttccttcatcagtgatttatagttttcatatttttttccatcttttttgttttgagacagagtctcactctgttgcgcaagctgcagtgcagtggtgcgatctcagctcattgcaaccgctgcctcccaggttcaagtgtttcttctgcctcagcctcccgagtagctgggattacaggcatgcaccaccacacccagctaatttttctatttttagtacagatggggttttgccatgtcggccaggctggtctcgaacctctggcctcaagtgatccacccaacctcggtctcccaagttgagattaaaggtgtgagccaccacgcctgaccttttgctagtttttggctaaatattttgtagattttggtgctgctgtaaatggtacttaaaaaaattaatttctggttatttattgctaatacatagaaaagcagttgatgtttgcattttgacattgtatcctacaattgctagactgacttattctggtctttttgcagattccttatgattgtctatgtagacaattatatcttctctgcatagagttttatttcttcctttacaatctacgtaccttttattgctttttctttgctttatttcattgattaggacctctggtatgatactgaatgggaatggtgaaaagaaacattttttgcattattctcaatcttaggggcaaaaatcattttgcctttcacctttaagtggagttgtatatctccttttactagtctaggaagatctcttctattcctgttttttttttttagagtttttacaacattattttaaaagactcctgcctagtgtttcataccattatttatattataccataatttagacaaatttctatttttttacatcaaagttattttctgtaatgagttatgtggctaaagtatttttacgtatctctaaatataaatacatttctaaaagtgtaattactggttcaaaggttacatacacagttttaaagcttttgatacacgttgtcaaattgcccttagaaatgttaacagataatgctcccaccagctaagtgtgtatatacctatttctagaattctcctcagtagtgaaaagaaggtaatttttgactatttgttaaaatagattagtttaattatttctgtcactagttcacagtccttgttaataatttgagaagttgaacttatatattatttttaaaattaatcattacagaaagcaccatattgtcacagttactctaatgcttttttcttttttgtggcccttctaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacggtaagaagagaggaaggagtaaaacgagaaatcttcaagaggtatattctcccctcactacacattcttcccagaagtgttattggggcaacataaaggggagaatatatttttagtatttattgatataatattctcattattaaagacaatcttgctttattaaaacgtatactcccctctggaggggatatgaagtctggactgaaatgggcatgagatgggcccattcagcgtaagaaagatagagtcaggtttaaattagtaatgtaaaattatcgtcatgggcaacaaatttttcccgtgtgtctcttatggaaagcaagcaaatgcgtgctttcacatttaattaagtttgaaatttaaaaacacgttgattctaattctaatctctgtgaaaatgaaaggatagttgttctgtagtcaaaaaggtttcaaagctgataatttcatgtcatagaaactgttaggtttctctccgtttacattatctgaagccatttaatctccacagcctgtcaaacctagggcaagacagagagggagaccaaagagcttctggttagtgttcattgtcctctattccacagtcataaactgccatgtatcatctgttttctcttcctgttattgttaccgaggtacttgtgtcagaaatgtctgtcctttaacatttggattttttcttaattattacaactcattgtcgtgccttgctgcttagaaacaagctatgaaaatgcaaaattctctcattctaccaatatttttgactacctatgtcaaaggtaggtaagtcttttggggtttggaaaagtcacatcttctgtcttaaaggaattcaaaatccatttgaaaataagtatttccaagaaaaaaattacttaaaaggtattttgtgatgtagcagtatctcaatgcctgaatggatggttagaccgaaaaataagttggaagaaaaagaaaacactatgttggtgggagagtcacaaaacttttataaagcaaatagagtttgagttggacctgacacaatggggaatacacatttggagaagaaagaacacattctaagcaggctcaagtctgaagcagtaagtgtggctttggagtcacagctctaggtttaaaatttaaagtttaaaattaaattccaggctgggcaaggtggcttatgcctgtaatctcagcactttgggaggctgaggtgggcagatcacctgagatcaggagtttgagaccagcctgggcaacatggggaaacttcgtctctactaaaaatacaaaaattagctgggtgtggtaacaaaaattagccaggcatggtagcgtgcgcctgtaatcccagctacttgagaggctgaggcaggagaatcacttgaactcaggaggctgaggttgcagtgagcagagattgcaccacaacactccagcctgggcgacaagagtgagactctgtctcaaaataaaataaaattgagataagagaagatagtttctactctgccacttcctaactttatgaccttagaatagttactgatctctttaagcccctgtttttaatccataaaatgagattaattcataccacttgtaatattataaggataaaattaattaaaataaatgagattacaaaatttctagcccagtgtttggcctgtagtaagccctaaataaattgaaactatgttagaccttttaggtccaatttgtgaaggttttgaatgttggctatagaatgaggatgattattataataaaaatagtctattcagcacctactaagttgcaatatggatagaggctttatatatacatattatttttaatggttattctaatcctgaatggtcagtgttactagccccactttattgaaccaaaagctgagcttgaaaaggaaaaataacttctcagggtgatgtaactagtaagtggcattgctagaattcaaatcagggattatttaactcaatcacttgccatagtgcctcctgatgtgccatagttatatggaagcaaactaattctccatttctgggctctcattttcattgtggtagccatgacatccatgactcattaaaattaggactagatcccagatcctctggatcacactttaatgctctttcccagttttgaattttatcagataggcagttaagtggtgtttaggtagtttaatggaggagtgatattgatgaaaatggcctttgaaatgatctggcaataagtacaaattggattggaatatgaagaaattatagacaagccacccacttatgagacttttgaaaactttattggattgttttatttatgtattttgcttgagacaaggtcttttgctctgttgcccaggctggagtccagtagcatgatcatagctcactgaggcttcaaactcctgggctcaagcagtcctcctccttgactataggcacacaccaccaccaggcctggctatttttttatttttggtagagatgaggtcttactatttgcccagattggtctcaaaaactcctaggctcaagtgctcttcccgccttggcctcccaaagtgcagggattacaggcaggagccacctcctggcctcctggattattttaaattataagataacaacctatttgaacaagtcaaatggtatagttaatacagttattactctctgcttgcagccccagccagttaatcttccttccctatcagatggtcactgtgaatggttttgatgtaatcatctatagttttcttcatgtttataaaatcacatgaaaatatgagtatgtataaagaggtttttttggttttgctttaattgaattatataaattattttcagtttgtttttttttttttttttacttaataaatgttttgggcagccgtctaggtcattacagatagattttactcatacttttatactaattgcataatatttcataatatgcatataccataacttgttcaaccatctctcttctctctctatctctctctctcatatgttcatttatccttgtattctggagcctgcctccctccctccttgtctttttttttttttttttttttttttttgagacaggctctcactctatatcccaggctggagtacagtggtgtgatcacagctcactgcagcttcaaactcctgggtccaagcaatcctctcatctctgcctcccaagtagctgggactacaggcacatgctcagctaatttttgtatttttttgtacatgtagggttttggggtttcgccatgttgtccaggctgatctggaactcctgagctcaagtgatctgcttgcctcagccttccaaagtgttggcaccatagacgtgagccaccatgcctggcctctttcttcttttccttccccttccctttcctttttgtcttgctctgtcacccaggctagagtgcagtggcaggatctgggcttactgcaccctcaaccttctgaggtcacatgatcctcccacctcagcttcctgagtagctgggaccataaacatgcaccaccatgtccagttaatctttaaattttttatagagacagaatctcaatatgttgcccagactggtcgtaaactcctgggctcaagcaatcttcctgcctccttcccagagtgctgggattataggcgttagccattgcacctgacttttatttctttagtgtatgtttttaatgttttaaacttttttattgaaatatgactaacatatgtgctttctgggttgaaattcttcatttgttgcatttgccaaatttaatgatgtaaatgctgtcctcaggactatttgtaatctactgacagtttgacaagactcacaaaattactgttaaacagttgtctgtcataaaccaatatgaaccagcttcaacacaccaatgcaacatgcttacagaaaggtatacaaatcattactgtacagctcattgtatgtcagtgaagtgaatacaccttagacccttttcaatactctttagtcttttttaaaggtaactaggaccaggtgcagtggctcatgcctacagtgtcaacactttggaaagctgaggcaggaggatcgcttgagcctaggagtttgaggccagactgggcaacataatgagactctgactctacaaataaaaaattaaaaaatgagccaggcatgatagtagtcccacctgtagtcccagctactagggaggctcaggtgggaggatcccttgagtccaggaggtcacggctgcagtggaccatgataatactatggtacttactccagcctggtgacagagtgagacctagtctcagggaaagcaaaaaaggtaaccactgtcctgacttctgacactgtagttgattacttttgagggattgagagactgaaataaaatggtaacagtgaacatagaaacatagaatcctactacacacatcaaacattatgggattattaaatatctaaatttgaaaagctaaccttttataagaatatcaaggaggctattttcatgaacttttgagtagggaaagatttctttagcaaaattcaaaacatgaaggataaaggtataagatttgactgttaaaatttataatctttgatgcagcaaaagatactataaataaatacaaagataaaaccacaacctaggagtatctgtttggagtgcattaactgacagaatattagaatccaggattaaggaagaaaaagaagcaaatcagtaggaaaaaaacagcctaataaaaatatgggcagttcatagaaatgaaaatccactgggtgataaactttagaaaagataatcaatgacagcacttctcaaaataagacatttacgcggccaacaaatatatgaaaaaaagttcaacatcactgatcatcggagaaatgcaaatcaaaaccacaatgagataccatctcatgccagtcagaatggcgattattaaaaaggaaacaatagatgctagcaaggctgtggagaaacagaatgcttttacactgttggtgggaacgtaagttggttcaacagtatgacgattcctcaaggatctagaaccagaagtaccatttgacccaacaatcccattactaggtgtataaccaaaagaatataaatcattctactataaagacacatgcacacgtgtgtttattgcagcactatttacaatagcaaagacatgaaaccaacccaaatgcccatcaatgatagactggataaagaaaatgtggtacatatacaccatggaatactatgcagccataaaaagaaatgagatcatgtccttttcagggacgtggatgaagctggaagccatcatcctcagcaaaataacactggaacagaaaactaagcactgcatgttctcactcataagtggtagtttcacattgagaacacatggacacagagaggggaacaacacacaccagggctttttgggggatgggggttgaggggagggaacttaaaggacaggtcagtaggtatagcaaaccaccatggcacatgtatacctatgtaacaaacctgcacatcctgcacctgtatctcgtggttttttttttttttaaggaaaaaaaaaagacattcaatgttattcattattagggaagtgataaactaagaaaagataaaccatagttctgtaaaattcacccccactagattgaaaaaaaaaatcccattttaaatgtttttaaagacgaatataaccatttatgagggcaattgggcaataatgttgaagatgttcatgtactatgcaataacatcaaattgctaaatgtaccagatatttacaaacgtgaaacaacaagaactctcgcatactgattgcaacagccactttggaaattgtttagcattatatactaaagctgaagtttttctgccataactagcatttcaattcttaggtatatacacaaccaataaacatacatatctcatatgctaggaaatatatacaaaaatgttgtagcattttttatacaggaaagaaaaatgaaaaaatgcctgttaatagtagaatggataaatcgtagcatgtttatacaaggacagtgaatctgaagtacaactacatgggcatggattctcacaagagtaagtttgagtaaaagagggcagacccaaaaagatactacatgatttgttatttaatgttcaaaaatgaaacaaaaactaactttggtgtttggggatacctgtctatagtgttaaaggttgcatgttttctttgtgaaacaaaagcaaggctgggcgcagtggctcacagctgtaattccagcactttgggaggccagggcaggcggattacctgaggtcaggagttcaaggccagcctggccaacatggtgaaaccccatctctactaaaaatacaaaaattagctgggcatggtggcgcatgcctgtaatcccagctacttgggaggctgaggcaggagaattgcttgaggcaggagaattgcttgaggcagggaggttgaggttgcagtgagctgagatcatgccactgcactccagcctggccgacagagtgaggctctgtctcaaaaaaaaaaaaaaaaaaaaaaaggcaagaaagttataaaagtctaggaggcttttgtataactttggagacaaggggttgtggatgtgctttggaaggaaatttaagtggagcttctgagaagctttcagtgttctgtatcttgacctggttaccatacctggtggtatttatggagtttgctttttcataatttattgctgaaccttaaaaaatttttgaaacaaaaacaagcaatagagtgaaaagcttaaaaaccactataggcttttaagttttactgtaatatttagtttcttaaaaactgaaaaagtggccagctgtggtggctcatgccaataatcccagttggggaggtcaagatggaaggatcacttgagcctaggagttggagaccagtctgggcaacatagtgagaccctgtctcaaaaaaaaaaaaagtgtgaaaaagctgggtgtggtggcatgcacctgtactcccagctactccaaaggctgaggcaagaggatcacttgagcccaggagttcaaggatgcagtgagctatgatggcactgttgcattctagcctgggtgacagagcaagaccccgtctctaatatatgtgtatacacacacacacacagattttttttttaagcaaaagatctaaaacaaatatggcaaaatggtaagatttgacacatttggacaatggatacctgagtgtgtgctatgttattttgtactgttggaaaagaaatgaattagctgggcatggtggcgcatgcctatcacgccagctacttgggaggctgaggcacgagaatcacttgaacccaggaggtggaggttgcagtaagccaagattgcaccactgcactccagtctgggtgacagagcgagaccctgtctcaaaaaaaaaagacagagaaaagaaaagaaatggagtctacccaattgctttttcaagatgacatgtccacgggccagtgttgcccaaaagtgaaatgcccaaaattgagctgttagtatgtgtttcagcaatgctggcataagcagatttgtttccttcaagcccctgtttactatgctaatgtttcctgtgaagtcagacaggaaagatctactgtatacaacattttccaaacctctagaccacaggcatttaaaagaattcccttaaggtaattattagcttgaaaaataatacctcccaacagaatcaaagaaactgaagacagtgaataaaaaattgaactagtatctgggagtctgatctcaaccagggacattccctcccacccccacttcaggacatttggcagtgtctggaggccttcttggttattggtatggcatcttagtgggtatggggtgaggatgctgctgagctttctatagtgcacaggagagccctccacaagaaataattatcctaccccaaatgtcagtagtgttgaggtttaaaaacccagcctagattgttgagattgtaagatttaggagaatatgtgttctcattgtttagagcagtttttaagccatttttctctttccatgtcattcacattgattgcacacctccatttaaaacctcttttgtaactttgcagtgattaggtgaatcctagagtataaaattattttgtttgttaattttttcttgaagtcttaaagggtaggcctttaagaaagattcttttagatttatagaggaaattgatataatggattcagctttccctcgttgctctgtagtactgtatacacacacatacagatacatatgtacatatccatccatatatgcagctgcctgtgtccaccaagctctactaaggcataccatacaaggcttgagggaatcataagacatggtcaactccacctctggagtattttgctgcttctgctagttcaactggaaatgactgaagaggcctgtgagactcccttcatgaataataaagcatttaactagaattcagcatttctttttggaggaggacatctgaattaagtggcaggtgaggaagagtggacaagagaaatgttgtcctgtatctaaatctgtacttaagtacaattttaaattggattattgaaactttaaattgctgtgcttttgtcttaattataattgaaatgagaatcctcatctcagaacccctctagaatataaactccaaggaaagggactttttctgttttgttcactgctgaattcccagtgcttagaatgattcttggcaggtaatagttgtgagtgagtaggtaaatgcctgaatgaaagaataaccaacttgaatgagtttcttttatgccctgagactgtagttttgttactttttgtctgtgctgtgggagacatacatacctcagctacaaagaatggcactaaaggcagatttttaagcattctgtatactgttatgccagatacagagcttgtagtattgccactttaagtgtttaaaagcaaaacatgaggagaatgacaggactgagaataggaagagacaccgagagaaaaagagaggcagttaaatcccataaaaaataaagcccggaattgcagacatgacaagtcagccttgggcaacagcgagtgaccggtcaactggaggaggagggatttgtaactgtcctgatggaagatttttataatgtgttgaagaaaaaatgatcagagatgacttatactttcataactgaccactcccttttgaatcttgtgcatatcctttaacactatacctcttcaggtatatctaacagagatccattttgatagatgtgttcatagtatgcagagtattatgtacagttttggcaggttaaattgcctaaggtcacgatataaccactgatagaaaatagtatgtcaccatggacctgagagttatgttggtttattaaacaatttttttttaattaccatattgctgtttacttcactttttttttttttttttttttttgagacgtagtcttgctctttcacccaggctagagtgcagtggcacaatctcggctcactgcaagcttcgcctcccgggttcaagccattctcctgcctcagcctcccgaatagctgggactacaggcgcccgccaccacgcccagctaattttttgtatttttagtagagactgggtttcaccatgttagccaagatggtctcaatctcctgacctcgtgatccacccgcctcagcttcccaaagtgctgggattacaggcgtgagccactgcacccggcctatttacttcacatttaagagcaaactgtccttggccaggagtagtgacacatgcctataatcccagctactcaggagacaggtactcaggagacagatgggaggatcacttgagccccgaagtttgagactagccttggcaacatagggagacactgtctccaaaaaaaaaaaaaaaaaaaaaaaattttaaagtaaactatcctctagaaaccagagttttagagttagcacagaggtgccatttgcttacattatcctattcattacaaatactttacttcagactagcacatgatttgggggcaaaactactgctgggccatgggttgccattaacatctttatgttctgagacagcattgaaaatcctgaacatgccaagccaaggccaggacttaccattccattttcatttctgtttgattaccataattactacactgctgacaacccttgatgattctctagaatttgatccttttggggataagcatgtccaccctcaatactaacaaatatgtcagcagtataggccctgttgcttgaagaaaattactacctgatgctgacaacattcatatctaagattgctgagtgacctgtatgtggatgggtctctttacactaatgccacattgttagtttactactgtgtaaaaataaaaagctaggtgctttctagtgaattcagcttatcaagcagccttcctaaaacattctcaccgactcccttgctccctgagaaaaagaaacccgtcccgaacaacccatttaaacacacacattttagtgctgatcatggactgttaagtgaaaattgcagttgtctaaatagatccttttcccactgtcacatacctttcattcttgctattatccatgatcatatttgcatgcatctgccttgtccactgttgtgtctctgaaaaatcatagtttgaagccctgactcttactataattacattaggaggtgggtggggggcagtaactaggtttagttgaggtcatgagggtggagcccacacaatgggattagtgcccttggaagaggaaacacctgagctgtttctctccctgtcatgtaaggatacagtgagaagtcagccatttacgagccaggaagagggtcctcaccaagaacttaatctgccagtacattgattttggacttcgcagctttcagtactatgagaaataaacttccattgtttaagccacccagtctatggtattttgttatagcagcccaagcagattaaggtatccactcttcatgttctgttccaactaaccaatctcagtgggtctcttgaccacccagtgtccagcagacaacaagtgctcacttacagccctgtcaaatttaccatcccctaaggacaaaaaaaaaaaaaaaaaaaaaaagaaaatcaccatgaatcactattctcagaggatatgttctcactggcccctttccatatttccacagccctgtcaaccatccccagagggtattaagatcatattccaaaacaagtcttcaaggagctgtatagctaggtattcattcattcagagatacatttttgtaaatctgtagtcattctgctagttattcagttttaatacttccatgtgaatatatctgaaaagtttatgcatgattacatgttctttatgccccaattcatgtgaaattcctcttgaccattattttgggatagcagacttttgtttctcttgcattttgtgattttctctttattgcttagtgagctaactttgctttatcctttctttgatagctatgttattacaatatacgttactcttaatgtttaatcataggcctgtcaaatgaagtgtttaatatagccatactagttgtttattgggcccttactgtgtgtcagccactatttgcttttccttagatacctcatttgatcctcccaataacacctcctaagagataggtataatacctcaccccatttttgaaatagaggtttggggaaactgagtgacttggccaaagtcacatggcagagctgggattgtgactatgtccagagctcccttttcaccagctattttatcatgttccttaatctacagtcattttggaatatctcattctgcaggtgtaggggctgaggttcagtgaggtaacttgctcaaatttacatagtagattaaagagctgggattcagtttctgattttgtgactcatattccagcactctttcgatttcagttacagcttatttatctgtggcttattaaagtgcttccatgctgaatgctcaagctgccctctcagatggacatagaggctgtacctcccttgttttagatgacaaaactgaaacttggattaaaagaattgcctttgtttatatagcaagtaagcaaaacttttgatacttaacccagctcttctaaaatagtcttccctgcacttctcaccatatggcagtggcttagattttcatattgtttgttgtcctcatttctctcttttctacacagtaaatctgtaatgtaggaaacttctctttagagatgatagattgtgggccggactattattttcttgtcagtcagttatacacttaatgtcaatacagatgatggaggtaaatatgccaagatgctggctaggattttgtggctggtttaacttatgttcctataaagcagcaaattggatataactgctgatgtttagaacctttagttctaaaatctaatgtcatgttggtgctcttgtatgccaacctgcttttgaatatacttcttggttctcttttgtatttcttagtccattattgtgtattctgggtcttatataagagaaggtagaatcaacttttggcttttgctttggaaaactcttgctttcatgtagcatttcttttcttgaaggctgacttgtgtgactttagaataggcctgactgtgaaattatctatagttgcttgcatttatgtagcctaaatttggagttaaggatacagtagccttttctctggttgtctaaaaaattatctgaaaatgttcccctcttcctaagataatgtctcctgctgaaaggaaatatgcagtgtaacacatggttgattattactggatctgttaaatgatctttcatacatcgtagggaatacattggagagtgtgccatcagttctagtacaaatattctagcatcatcatcgtcagttctcaggaagtttctctagccatccagccttgatcaacagctgaccaagtgcattctggttgataacattaattattttgtgagtatggatgcagtgtacccagttttcacaaagatcttctgttatacctagggcaaagaccatacatacatttcagaactttgggagccactttgtcatcccagaaaaactgttgtatcatattatgaaatagctgttcaaaatggtgctcagagggatgtcatctgtaaattagaatattttagtagaatccctgctgcagtctactgtctttatattctaaatatgttcataagaatgtctctgtgtttggttacaagtaaccttgagctattacaactattagaaaacaattattattggatttggatggaaaccttgtaaggatcttgcttccaaacttttggagaactagtatattctcatggcacataagcaataagcagtaaacatactatatttatagtcaaggtaagtgctaacattatgacattccccaatgaaaagatatctcaaaaatcccccagtatcccaacttctgcataaatacaataaggatctcacctacaacagttttgcgataaccagcaaattctcccttgtcttatgtcatttttgtgtgttctattaaaccaaaatacttattacaacggtacttcttaaaaaaagaagtaataactctacacagttttttttttttttaaataaggtctagataagttcagagttatagttgcaatgatatgacaagggtttccatgttagctagtagcatggctaaaaaagagtacatttatatgagaggaatgtgtgtcttttctaaataaaatttaagacatattactgttgaatcatgaaatgcctgaagctatattgtttgcctcttatagaatgcttacctgtggttcagtcagcattatttcatacaataaagcaaacagatatttttaatgtctttaagtaatcttgttgattttttttattttcctgtctggatgtagctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctgtaagtattttcatagaaagacagtgcttgtacactttgagcactgtaaagtagaaatttcaggaagctagatacagcatctccctgctaccttaagagggacctatggcctttttttttccatgtagaaacaacatattaatgtttaggggaatgctttgttccttttagtgcctaatataggggacagctaaattttccatgccagccattcaatctaagcctgagtcaggtcactgagttccaaaaatctgaaatggatgggtatagttcagttttctgagcagtagattctacacttgctatcagattctcacggggattctgaccccatgaatctcagtgtttattgtgcagtacaactttcatcatcaagatgctattattcctccttacacaacagccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaaggtaaaaatccaaaagctcagaaaccttcgcaaaggctccttgtcagttgcaaaagaacttagactgtcaacagaatagttctatcttttcccaaaggtctgggctgtttatttttcttcttttgcccgtctcattgtcagtgttcaaccatcgtgctccttacatttccatcagagtcagagatgaggagggtcccaaattgtgtaaaagccagtttgtagattcttcagattatttgtcccatattcttttttcttcttctgtaaccatttcccaatttgggaacagaaatatgcaaagaaaaactatggcctaagggtagtgcagaaatgaagacccagtagtgcttctagagtttatactctaattgatgacacagccatctaaccataatataagaaatcattaaaaatactgtaataatgtatgctatttaaggggtatagaaattagaaatgcttcaaagaaataatgtcagaaacgctccataacatctgattcagctaggattatgcttagctgtgacagaaaacccagtggtttatacaagattgaggtttacttcttatttatgtaaacaaagctctgaggtaagtcctttcagcttaacattctgtgactcctaaagtttaacccttgtcctaattattctcaccagagaaggtaggaaaaggggcaaaagacacagccacctcctctctctctcttttttttttttaagtaacagggtcagccgggcacggtggctcatgcttgtaatcccagcactttgggaggctgaggcgggcagatcacctgaggtcaggagttcgtgaccagcctgaccaacatggagaaatcccgtctctactaaaaatacagaattagccaggcatggtggcgcatgcctgtaatcccagctacttgggaggctgaggcaggagaattgcttgaacccgggaggcagaggttgcagtgagccaagattgcgccatcgcactccaggctgggcaacaagagtgaaactccatctgaaaaaaaaaaaaaaaggaaaaaaaaaaaaaaggtaacagggtcttgccctgtcacccaattttttttttttttttttttttttactttttgtagagatgatgggtctcacttagttgcctaggctggtcttaaactcctggcttcaagcagtccttttgccttggcctccctaattgctaggattacaggtatcagtcactatgcctggcccctctggtctctttaggaaggccctaggaagctatagcataacatttccatttatattattgcctatcattaatcacgtgaccaaagccagctgccaggagcctagaaaaatgtagtctttattttaggtggtcatatgaacaactaaaaattctaccatatggccgggcacagtggctcacacctataatcctaatactttgggaggctgaggcagaaggattgtttgagctcagcagtttgagaccagcctgggtaacatagtgagatttcctatgtccaaaaaatcatacacacagaaaaatttagctgggtgtagtggcatatgcctgtctgtggtcccagctacttgggaagctgaggcaggaggatcacttaagcccaggagattgaggctgcaatgaggcataattgagccattgcactcccaactgggtgacagaacaagaccctgtctcaaaaaaatacaaataaaaattctaccacattatattttggctataaattgatattcctagaccatttagaaaactacatgggctggacgcagtggctaatgcctgaaattccagcacgttgagaggccaaggctggaggattgcttgagcccaggagttcaagaccagcctgagcaacataatgagaccctgtctctacaaaaaattaaaagattagccaggcacggtggcacgtgcctgtagtcccagctactcgagaggctgaggtgggatcggttgagcctgagaggttgaagctgcagtgagccgtgattgtgctactgcactccagcctgggcaacggagtgaaaccccatctctaaaaaaataaatagataactacataaataaataactgtaaattggtaaaattacgtttaagtttctcagacaggagtactaatgattttgtctcttgcagccacgtatggaccagtactttaatcagatggagaaaattgtgaaagaaagaaaaacctcatctaggattcggttcatgcttcaagatgttatagacctaaggctggtgagtgggaaaaaaaataataataagcctgctggtccagtctctttaaaggaattgggttggggaaggatgtcctgttgtttacatgtgtaaagatagtgcttttgcttcaggactcagaatttggattggcaaactttccgtgggagagttctgagaagggacaaaaggcctattgccagttacgtgcttcttctccttattctgattatcaaaccatattgcaattttgtttgcgctttgtttttttttttgagatagagtctcactctgtcgcccaggctggagtgcagtggctcaatctcggctcactgcagcctccgcctcccaggttcagatgattcttctgcctcagcctccggaatagctgggattacaggcacatgcccccacacctgggcaatttttgtatttttagtagagacaggatttcacgctgttggccaggctggtctggaactcctgacctcaaatgatctgcccacctcagcctcccaaagtgctgggattacaggcgtgagccaccacgcccagccacttgcaatttgtaatcagccattctgaattcaaactccattcaaatgtaaattcaattaaatttagtctttgtgagctaaataatcagcaagtctcatctccacagtaaatacctttaactctctgagccttacatttttaatctctaaaatgaggatgttgcctaccttgcagatttgttgaagagtcaatggaataattacgtaaggtgcccagctcagatattggtgttttcttctctttcgtttttcctgtgaccctcctattctgctgctgggttttttttgtttttttgtttttttgtttttctcatttctcttaccgggtgcagtttttgttactactacttttctctgttttaagtttaactcctacagggagttactcttttgtaagtttcactcctacagggaatatactacatcaagccctacactagagaaagtgaacaaagccctacctcttatttctcctccacccaggccagatagcattgatgatgattctttatcttgctaagactagatgtggttgtcttcacccatgttatcaaccacttatatcagatgttgggactgttgctagaaagagaagggagaagtataaagtgacaacttattttgtccttaatacaggggataaccaaagggcagagtggtatggacctttgtgtagaatatcagaaccatgatattggagaaataaaagcatgagtcatccttgacttagaacccctatggaatgtgatatgatctgagtagtaatcccacagattaaggcaaggccaaggaatcctcatcatttttatttttctctcctcctttcaaatgtacaaaatactgatacagataaaatccatttagtccacagagaaatatatgccatgcttaaaaatataataataaatttgggccagtctttcaccctgttctttgtatccattggctattggaatatgtagtatacaattggccagttttgactgagaagattttaatccttcagctctaatcctaaactgctcatagtgtcatctataagatacatgagaaactgccataatacagcttttgtaggtattttgtacttttccagtagtaaaaattgctaatttttaaattttaaaaaatgttcagtttatctggcagataaccttattttctgcttttatagtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgaggccggaatccaccagggtttagagaacttggaagtttcaggaatacatattaagaattatgtatttaggtataaaatgagatcagaaagaacagcccaaagaatagagtggtgattgttaggtgaagcagtttcacctgaagagtaaagttactgagtaaaagtagagaatgcaggaacaaagcatgatttctttcactacttaaaagccagtaagcaataagactttattgagcatcttctatatactcagaattggtgagactagaaaaggaagtggaaaatgtagttacttccctctcaaagtgtacagtttatctggtaaggtaaaacttttgacaagcaaaagaggaacatttgttaagcaaatggaagatagtatatcaattatgaaatgtgttctccattaactgttaaaatttagagaaaaagaagagagacagaaagctgaaagaaaactttatttaagaaaggggcactttgtagcaggccggacgcagtggctcatgcctgtaatcccagcacttcgggaggctgaggtgggtggatcaattgaggtcaggagtttgagaccagcctgaccaacatgatgaaaccccgtctctactaaaaaatttgctggacatagtgatgtgtgcctgtagtcccagctattcaggaggttgaggcagaagaatcacttgaacctgggaggtggaggttgcggtgagccgcgatcgcgccactgcactccagcctggggaacagagtgagactacatctcaaaacaaaacaaaacaaaaatagagacatgcaaaaaaagtgaaagatgaagtagaaggcattttaaacctgagacgatagtccatttactaagtttaggaacgttggaaaagaaaacctttttcagagggaaatgataattttctggctgatagtaaatactcagtaaccattagttattgtcacagacacagtagagctcatagtgaagttgttaggagagatgaattctgcatggaagaaagtttacttttaagtttcttgagataccacacttaccttcctcgctctagtacctagtgcagtgccttttgggtaataacttttatttattattgaaccagattgagagggaaaaggagaagataccaaagcctaattcatggaggatattcacatatgactaaaggaagaaaagaactcttggaaaagtgccagacaagtggagagaaaggactaagatacaagtgtcatagagacaaggaagaagcaagtctgtttatgatcagtaatatcagatagcacggagaaaatcaagacgttatgttaggaccagaaaagcttttggatagacagttcggtgatctttcaatttattaattcattcagcaagtatttttttttgagatgagtctcgctctgtcgcccaggctggagtgcagtagcgcgatctcggctcactgcaacctccgcctcccgggttcaagcagttctctgcctcagcctcccgagtggctgggattacaggcgcccaccaccacgcctggctaatttttttgtatttttagtagagacagggtttcaccatcttggccaggctggtgttgaactcctgaccttgtgatccacctgcctcggcctcccaaagtgctgggattacaggcgtgagccaccgcacacggccctcattcagcaagtatttattgtctgtcacttaacaaggcactcaaagtcccttccatcatgcggcttacatcttatggtagaggggagagaggagacaataaataataaatacttaaataaaatatatcatttgtcaaataaatttgtagaaaaacaaagaagggagaagggactagggagtgcaaatcttggtgagtagggtgcagttttaaacaggaaaactggggaaactataaaagttggtattgtttgagcaaagacctgaagcaagtgagggtgttaaatcatgtggaaatctggggaaagagacttttaggcaaagggagtagtaagtacaaagaccctgaagcagcattttcaaggaatagcaagggggccagtgcagctgaacctaagaagggcctgacggggagagtggtagaagatggggacttagaggcagcaggagccagattatttagaggccatttgtaaggaatcttctctttttctctgaatgagacagaaaggtatcagaagtgttttgaacaaaaaagtgacgaattttgtactttactaggatcacactggctgccatgatgagcacagctgaaggtagaagcaggaaggccaaaacacgtctctgcagtaatctaggaaaggggtgttggtggcttaaacaaaactgctaatgttggtagtagattctgaatgtattgtataggtttaactggcaaggtttactgacaaaaattggatgtgaagtgtgaaagaggagtcaaggttttccacctgtgcagctgaaatgttggagaagcagatttgggaaataaagcatacttctgtcatttgatcccattaaatacaatatactttagaataaataatttccatctgacttctccgaaagtgttctagtcattaattctgtgaatactggatttagccctgccttctccagcaccaggtattcatttgtgtcagttgtttgtttctaggtcagtaatgtttcatgggtgatccaaaataagcagtgcttctgctgatacagggtgcttctgctgatacagggtgcttctgcttatattttcctgccatgggattaaagatattgtcatcaatgctttaacatcttctgttgtctttctccttggttttgatgaaaatattgctcactctttcaatgtaaaactgacttgagacagatgagagactcccactctgttctccctgcaggtgtccagagagtggacgaaggtgggtggaacactgtacaaggggccaagaacagtcgggtactggacccctcaaaattcctaaaaatcactaaggtgagtctgacatttaaagtacaatttacgctctcctttgatgcctttgatattaaaacacacacacacacacacaatttacaatagttgcaaaacgtgtctcaaaagtacttattaaagtaaaacagcaatattgcaaatccatggggtggttattttttaatgcatttttcttcaagttactattgatcaatgtattctacaaactcatttctacattttctttttttttttttttttgagatggagtctcactctgtcgcccaggctggagtgcagtggcacgatcttggctcactgcaagctccacctcccgagttcacaacattctcatgcctcagcctcccaagtagctgggactacaggtgcccgtcaccacacccggctaattttttgtattttttagtagagacggggtttcaccgtgttagccaggatggtctcgatctcctgaccttgtgatccacccacctcggcctcccaaagtgctgggattacaggcgtgagccaccgcgcccggcctcatttctacttctataaggatttactaaagaggaaaagactaggttacttcttagacataagatgcttaatatacaagaggtaataacaaagatattttagaagcctaagtcaattgcaggcttttacacaatgtatccgtagctctggggaaaaaagcaatcacctgtttaaacctaaccatgaaagatttgccttatccaaggcgtaaaggaaaccacagagggcctactagaaatcattctgtaataaggatttaagagactctgtctgctttcctctctttttgagagtctgtgggcagtaagaggaaaaaactttctgtagcaggtattttcagcagtaaaagttgatcattgtaaggaggatgaagaactttggagaatgtagagaaagcagaattaaatatgataagagtggaaacttctaaagtccagtgggttttccaaatcatttgcaagtctagtttgatccttatacttcccatagttctgaaaatcggcaccctgctagcaaaatactgaagacaatcaaaactaatgtgaaaatactacatgaaagaagataactgacaagaagtattaagaaaagtctttaagaaaattggaataaaatgggctatgtcatttgcatcttcacagttttgtcaaagctttgcttcatgatagaaaattctccttctgaatctctcttaataatgtaattagctaggatccttttctccaagattctggtactttcttctagttgtttatatctcagagtaggaattccattgctgaatacaatttgagtcttacccatctccatttccatctagagacagttttaaccaaaagtttatgtttaaagaagtcctccagcattttgaaaaatgtgtcggtatttaataacaacatttgtatttttaaatattatgctttccgtgcttggatactataaaaacagtgctggtatcaaacctccaacattactaccttaatatttttaagtatgtaaattgctaataaactttgtgtattcagatagttatactggaggtactatacatgggtatcctagaacaaaaccgttatacatatttattgttaattgggagtggtttgtgtgaaagcatattacatagcatagcaacatatatattatgagctgtcagaccatagaaataccttttttacaaagcgctacattacagcttttatgttatatgtattttataataatatgcattacagcgtaattttatttcacttgtagtaaagttgtgcttggaagattaaacatgagatatcaggcaccttaacttcctgtgctccctgcctaacattccaatctctttcttcttattctttattgaatactcacatcccactgcctgtctctagccaacatgaaatttttatgtctgttgatctgttttctgacagtcatgtaaagacactaatgaattaattttgtagtatttgtattttttatttttaaaattaatgggtattgtacaagaagaatgattagaaactgcttattacagttagcaaattcataaaccatcttaaacaggaggacctggatgcattctctagaccaaacagttttttgtggaaactggagtccagggaagtgcttcaggggccacatggatcccagtttaatgagaacagctccaatttctgtttctattaaattggcattccaaacaaatttttgttgctaaaattggttctacttcactgaagaagaaaaaaataaaagaaaaactattcttctagaatatttcctataattgacttgtggtcccttatgttacagcctacaattgatgaaaaaattcagctggtacctaaagcacagctaggcagctggggaaaaggcagcagtggtggagcaaaggcaagtgagactggtaagtgtgtgtgtcccttctcaaacctggctgtggcttgttagcatttgccttacagcgcattcccatagtcatcgaatgatggtttttgggaaagatgtgtagactaatcatgcctaaaattttattggtagccctttcctttcaacatagatcctttctcaggatccttaaataattttaagtatttttttaatttcaattcattcatttagactatttaattaagacctttatttatttatttatttatttatttatttattatatttttgagatgggatcccgctctgtcacccaggctggagtgtagtggcatgatcacaactcaccacagcctcaaccacctaggttcaagcaatcttcctgcctcagtctcctgagtagctgggactacaggtgcacgccatcacacctggctgatttttttttttttttttaattttttgtagagatggagtctcactgtgttgcctaggctagtcttgcactcgtgggctgcagtgatcctcccaccttggcctcctgcgtgctgggattacagttatgagccacactcagccactaagaccttaattttttaggttccctttttgttgttgttcacaaatttaatatagctagagaaattactgggaccctaaattaaaagggaaactcattatgctgataaaagaatcttaatatgcagagcatttactataattttagggagctgtaaaagaataaagaaacattgttcaaaatctttttcgaaaatcagattttgagagatttgacctcaggaccaaagatgtttggatctcacaaacacatcttactagcttgaggaagcccaatggaaagaaaaaaaatttaatgttaacctacttcctatatgtcccttctactaagtaatttcaacctttttttctttaaattttaaaaaatgtcattattcagtaaaacccacatgcatatttgtgcacaaatgagattggagcatttgtgctggttagctttgttaaagttttgttctgttttcgcttgccttcctcctcctatatgccactcccacccctgtttactatgtttttaaaggaaccaatggttgaaataaataaagacttctaaactctattatgtgcaaattccctctaacactttgcttctcagaatatggtagagggaccaggagatgggcgtcacctaagcttgttaggaatgcctggtctcaggccttacctagggatgcagatgactgattatttgcattttagtcatgtgatttgtatttttttctaaatcctcgacatgtgtagatgccttacggtcaagtgcttccagtttaaacagattctctgccctgcaacctccagcaccctcagggtccacgccatccacgcctgtagagtttgattcccgaaggaccttaactaggtgagaaccctgctttttatgtctactcaaggctggcccgcttgccagtatgtgtggcaagataagaacaagggttttgatagtaatccttatggatgcattccttttattcctaaagttgatttctttaatcttcacacactataatttctaagataggaacataattgggtggtgaatttgggatgggatgggagggaagggattcttaagaaagctaggcccacccaaacagccctggaggcatgtctaggggctccgcaagctaatcctccagatgttctagaagcacctagcattctcaaccatgggaattaaagaacatgacaatccacccatacatttctctgtcacactcttcatgttatatttgaggttgtccttcagtttttgctagtctccatatttcactatctttctgcttttgcttttctaggattgatacagtcaagtatcctgttggctggtttacataaaatgaatgggcaccctgtagtgcagtcacaaaaaataacattttttacataagcactttcagaattgaagtttctttaagctctaaaactttttttttttaattattattttttagagatggcatcttgctatgttgcccaggctggcattgaactcctggtctcaagcgatgctcccatcaggctttttattattattattgtaataagtttgattaggtagactttgtaaactgtgttcttattcccttgacttctattgaaacaaagtatagttagcacaaggcagcttttcatgatgattcaggttgtcattgagtatcacttgtggcgctttgccctgtcataaatgtcccctaatggttctgcttcctaagcacttgtgtatgttctttcacaatagttagaccattttcctgcccgagtctctccttttcccttttaatttgctgcttctggtccgccacgggccaacgaactgtttgctcagctggttagaattgtctaaaagaagacgaatcaggaaatatggagagtctctcttaaaaggaataaaatatatagcgttggctaatccaagacagcttcttcttgattctcaaatattttccatatgtttaaagattctaaataaaaaggtatcattgcataatttctgagatagtgataccatgttcttataatatttgtttccctttcatttatgtaactcatactttatcattgtcttctttattcctgaaagattttttaaaactaaaaaaagaaattgccaaaattaaggccgggcacagtggctcacgcctgtaatcccagcagtttgggaggccgaggtgggcagatcacctgagatcgggagttcgagaccagcctgaccaacatggagaaaccctgtctgtaatcccagctactcaggaggttgaggcaagagaatcacttgaacccgtaggcggaggttgcagtgagccaagatcacgccactgcactccagcctgggcaacagagggagaccctgtctcaaaatacataagtaaataaataaataaataagttcagctccaaattggggaaatgtgggctccacagaaagaagtggttataattactaggggaacagggcccttttactgagagaggaacacatacaccctcatcaacacagaggcaccgacacagaaaggaagaaacagagtcttggagaaagagacagagtcagggtacccggagtcagggacagagcacacagacccaggggacagacagaggtgcatagacgatagattcccattcgctcagatggagccagagcaatgcccgggcacagagagacccagcagctgcagaacagaggagacgtaggatagaatggtggctagacaggcgagggcaggagaggaggagcaagcaggggccttcatggggatctgtctgtccgtacagcgagaactaccagcctgctcatccgatcatcgcnnnnnnnnnnnnnnnnnnnngctctctgctacttcctcctcgcagtttcaggccagtctcatgcctcagcctcccaagtagctgggattacaggcacccgccacctaacccggctaatttttgtatttttagtagaaacacagtttcaccatgttggccaggctggtcttgaactcctgacctcaagtaatctgccctgctcggcctcccaaagcgctgggattacaggtgtgagccaccatgcctggccaccactgacatgttaaagtgttaaatagtatcccttcagagaaaaaagttaaaacatcttaataaatattccctttaaagcactcttttacttgtttgttgaataaactttgaaatataattggtgcctcacacatctaatgttatctgtgaaaaattctgtatactttcagaaagtcttagtgttattttataatttgaatatgtgggggacatgggcttgtctttcctttgaaaagtgttgttttgtcttttaagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcaggtgagagacttggcttaaacagatgcagatttgggttttaaatttggaaggaaaaataaaaaagagactgtgcctgagtagattttagaattaacacataatagcaacacataccagcatctgaagagttaaagggtacttcatagttttataacagttctcattccctaggtatgccttagctgaacagtttgtaaattttctcctttctctattaaatgttatggtgaggaggtcctcctgctgtattttaagcaatctgaatttcttacaagtccctgtaacatcccacacttgacgttgctgttagattgtgtatgctgtgtagagctcctcaaatgtgtgaaaattctcattgagccactgcaagacaaaccaaagagaaggtattaggttatctttagctgacttcatcttccgtggtaacctgttgtttttgtatgcatttagcatgtatatacttagaggacttgctcggataatgctctaaaaattgcttcatgtatttaacctgtgtttcagtttccttatctgttaaatggggataagttgtacctaccttttcaggatattatgaaaattaaataagaagttaatacacgtaaacacttagaacattacgtgataaatacaaggttttcaaaaagtattaaatgttgtgatgacgaatatagcaatggaaaacagtttaaattgaagattattttcagcctcttttaaatattagtcatgaagtaatagcagttttagttttttagtatttatatagctttctaatttgtttcactatataaattgtatctcttaactgtagtccctaaatggatctcagagacaaattgaagtgtcttctcccaattggtgtaactttagataatacagctttagggacatatggcttttttaaaatctgtgctagatacttttgaaatataacaggataggacataaaatatcttgggtgtaatgaataatgtagcacagctgccctatgtgtttttattgtctggttcatttgtacacttaccagatgcacagtgaatgtgaggcccttgatccctgttctcggccttcagtctgctgagtcagaaagaccttttttagtaattccacgaaagacacaaactgagaaaggtgctatgaaggaaggaatttagttctaagagaatacttagaactatctggtaccaaggagctatgtagaataggggcaaggggaggtttccttcatccgaaggaccagtaggaatgaaacaggttcgtaggcaaggatgggtgtgaaacagagggaaagagcactccagacaggattactgtgagcagagctgtagtaggaatagccacggtttgttcaagcagctgcccaagatcagtgtggctcaagcttagtggcgagcagggccctgacctgtgcaggattgtgaagacctcatgtactcttcatctttgaagcaatggggagcaatcataatacagaaaggaacaaaaaagctttaattaggaaagtttatcatgttcctaaatcttgttcattgttattgtagattataaagttacttagtgcgaatctattctaaaacaaaaggtttctgtattctgtttttatctattaaatgtcttgtagctattaaaataatgtaatagcacataatattgtcaaccataatctcactattttaatagtaatttttattatttttactttttttggggggcctcactaatagcaaaaccagaaatttcagcaatgtcagctcatgacaaggctgcattatcagaagaggaactggagaggaagtcgaaatctatcattgatgaatttctacacattaatgattttaaggtaaatgagattaaaaaaaaaacacacacacagtaagtcctttgatagtatataataacttggttctggtctaaatcaggtgtcattgtgaactgataagacttaggttgagtaatacaagtcctacacaattcagtttgcttaacgctgatgcatttctgccaagtactctcttttaatttgatactataatttacaacatagagtggtgggcagagagtatgagtaccaatccatccccactaagggaaaaccaaattgatttctatattaaggaacaaaaacaacacattatcattatgaagcatttctggcaccctgtatatagctgtcatggtctttttttttttttttttttttttttttttgagacagagtcttgctgtgttgcccaggctggagtgcagtggcacgatctcggctcactgcaacctccgcctcccaagttcaagcaattctcctacctcatcctcctaagtagctgggactacaggtgcccgtcaccatgctgagctaatttttgtatttttagtagaggcggggtttcaccattttggccaggctggtcttgaactcctgacctcaaatgatcacccacctcggactcccaaagtgctgagattacaggcgtgagccaccacacctggcctgtcatggtctttataatcattctgttatcattctcatattaatcttgaaatatggccagcattactttttctttatttcataaaactgaggcataaagaaacaagcaatgtgccaggtcagacagcctaagccagagatttcaagacaaggccttgaatttgccctttaacccttaccttctctttaatcttcattttgagatagtagtgaataagacatttctacctgaccttgtgaaccctatagtctagtggcagagacaaaccataaacaaataactccactagcagttacttaactgtagttatgataaatgctagtagacctataggtcttaggagaaatccattaatgggatctgattaagtgatgtgaggtcaggaaaggctaatctgttaaaacagtcttatctgttaaagtatttgtcagatatattaactacttttgctgctttggcactatattattaaaaattctttcaagattatttgttttcttggccgggtgcagtgactcatgcctgtaatcccagcaccttgggagctgaggcaggaggatcacttaagctcaagagtttgagaccagcctgggcaacatgataaagccccatctctacaaaaaatacaaaaattagccaggtgtggtggcacgcatctgtagtcccagctactcaggaggctgagatgggaggatcacttgaagcccgggaggcagaggttgcagtgagccgagatcatccactgcattccatcctgggtgacagagtgagactgtctcaaacaaacaaaaaaaaagaaaatattacttgttttcttaacagtgtaatcatcatctgctttccacatataaaaatcaccttggttatctatagttcaatcttctaaagccttcaagcctctgaaattcttcaaaattcagaagaagtagaaggaagtttttgatgatgagtgaggtggaggtgagtgctttgcagaaactgttggaaatgtaccaaagtaaatgaacattaacgggaaatagccaaagaataaacctgatgtactgtgattcatcagttagcctcctggaaaattaggggtattcttataaattggcagcatagcctttttcttgcatggaagtagggaaatgtgaacgaattgcaaaaaaattagaatggccaagaaagatgaaacgccaagacagtaaggaagaaaacagtggagattggcttcagatgtaatttgaaggatgtacaaagtcaatgaataaccctttaaaaggggaaaaatatgatcctgtgatgaactggaggtatagggagtaaaagaccttagtaacacctaaagagtacaataggaggactctttggagaatcatgagccctgggccaggcttgcaatacagaaggggcagaatcgttgtatctttagaatttcattgtgcagtgtacaaagcaactgtgcctgcaatatggttaaaacaggtattaacattgggcatttactgaggacttactctgcgttgggtgctgttgtacatattcggcatgtattagtttgtattgtcctcgtaacattctcctgaagttgatgttattatcatacccatttttcagataaggaaactgaggtgcaaagatgtaaatcaacttgttcaaaatcttaactgctaataagtgccagattgaggattcaaagctaagtttctagcttcagaggagaaaatgctttatctcattacctttggggtattagtgtgtcaggctaaagacttaaagagctgatcttaaaaatattttttccaaatatcttcctattaggtgctattgtttttaacagtgattcaaattaatatttattgagggtttattttgtgcctggcactgtgccaagttcttatacctatattttatatacattcctcacggtaactctaaaaagttaagcccaagagattaagttaaactcctaaactctaaagtagtaagtggcagagccagggttcaaatgcacctctgtctgaccccaccgtgcatgttttagcctctatgctatttatttattgaatacctaagtgtgctagccacattttaggggttatgactgggtataccatatttgtagtgaacaacaaaatctgcttccatggagcttacattccagtggggagatacagacaagtctggccctaaagataggtagtaaattaataaataaacagtagctaccaaaaaaatgttttcagtgccaaaaactaaaattatgtgatttgatggagtcagggaagacaggaagtatcatttcaactaaaagctcaaagacaaaaagaagcaaaccataagaaaaccagatggaagggcgaggttatgaactgctatgacactgtgagtataatgatatagctggaagtattacccttgaaaaccagcgcaagacaagaatgtcctctctcaccactcctattcaacatagtactggccagggtaatcaggctagagaaagaaataaagcatattcagataggaagagaggaagtcaaactctccctgtttgcagatgacatgaacctgtatctagaaaaccccatcatctcagcccaaaagcttattaagctgataagcaacttcagcaaagactcaggatacaaaatcaaagtgcaaaaatcactagcatcagtcaagctgaaagccaaatctccagtgaactcccattcacaattgccacaaaaagaataaaatacctaggaatacagctaacaagggaagtgaaggatcgctacaaggagaactacaaaccactattcaaagaaatcagagatgacacaaacaactggaaaaacatcccatgcttgtggataggaagaatcactgtcatgaaaatggctatgcgacccaaagcaatttatagattcagtgctattcccattaaactcccactgacattctacaaagaactagaaaaaagtatttaaaaattcatatggaaccaaaaaaaggagcccaaatagccaaggcagtcgtaagcaaaaagaacaaaactggaggcatcacactgccctacttcaaactatatatatgtattttttttattttttatttatttattatttattttttttcttgagatggagtcttgcactgttgcccaggctggagtgcagtggcgcgatctcggctcactgcaagctccacctcctgggttcacaccattctcctgcctcagcctcccaagtagctcggactacaggcgcccgccaccatgcccggctaattttttgtacttttagtagaaacggggtttcacggtgttagccaggatggtcttgatctcctgaccttgtgatccgccctccttggcctcccaaagtgctgggattacaggcgtgagccaccgcgcccagcctacttcaaactatattacagggctacagtaaccaaaacaacgtggtgtggtacaagaacagacacatagaccagtggaacggaatagagaacccagaaataagactacacacctacaattatcttatcttcaacaaacctgacaaaaacaagcaatggggaaaggattccctttttaataaatggtattgggatacctggctagtcataagcggaaaattgaaactggagcctttctttataccatatacaaaaatcaactaaagatggattaaaatgtaaaactcaaaactatgaagaagaaaacttacacaataccattcaggacataggcacaggcaaagatttcatgatgaagatgccaaaaacagtgcaacgaaagcaaaaattgacaaatgggatctaattaaactatagagcttctgcacagcaaaataaactatcaatcaacagaataaacagacaacttacagaataggaggaaatgtttgcaatatacacatccgacaaaggttttttttgttgttgtcttttttttgtttgttttttgagatggagtgttgctcttgtcgcccaggctggagtgcagtggcgcaatcttggctcactgcaacctctgcctcccgggttcaagtgattctcctgcctcagcctcccgagtagctgggattacaggcgcccgccactacacccagctaattttttgtatttttagtagagacggggtttcgccacgttggccaggttgatctcaaactcctaacctcaggtgatccgcatcccaaatactgggattacaggcgtaagccaccatgcccggcccccgacaaaggtcttatgtgcagcatctgtaaggagcttaaacaaatttacaagaaaaaaaaaacacacactaaaaagtagacaaaggacatgaacagacagtactcaaaggaagacatacatgtggccaacaatcacaagataaaaaagctcaatatcactgattattagagaaatacaaatcaaaaccacaatgagataccatctaataccagtcagaatgactattattaaaaagtcaaaaaataataggtgttggcgaggttgtggagaaaaaggaacacttttacactgttggagggtaaattagttcaaccattgtggaagtgtggcgattcctgagagacctagagacagaaataccatttcacccagcaatcccattactgtgtatatacccaaaggaatataaattgttctcttataaagacacatgcacacgtatgttcattgtagcactattcacaatagcaaaaacatgcaatcaacctaaatgcccatcaacgatagagtggataaagaaaatgcggtacatagacaccatgaaatattatacagccatacaaaggaccaagatcctttcctttgcagggacatggatagagctggaggccattatccttagcaaactaatgcaggaacagaaaagcaaatacttcatgttctcacttataagtggaaactaaatgatgagaacacatggacacgtagaggagaaaaatgcacactggggcctactggaggacagaaggtggaaggagagagacaggatcaggaaaaataactaatggatactaggcttagtatctgggtgatgaaataatccgtacagcaaacccccatgacacacatttacctatgtagcaaagctgcacatcctgcacatgtacccctgatcttaaaagtttaaaaaatatatatcatgatatagctaattgaccctttatgcaaacacagtgaatgaattcccattagaagacatttaatcacttccatttaaatactgaggaatgatttttatttatttatttatttattttttggagacagagtctcgccgtgtcgcccaggctggagtgcagtggggtgattacagctcactgcaacctccgcctcccgggttcaagcgattttcctgtctcagcctcccgagtggctgagattacaggcgtgtgccactacacacggctaatttttgtatttttggtagacacggggttttaccttcttggccaggctggtctcatactgctgaacctcaaatgatctgcccgccttggcctcccaacgtgctgggattacaggtgtgagccaccgcttccagcctgaggattgaatatttgcattcatttacaagtcctcttgaaaaggcataacaatgatgttgattggcttaaaataaggttaaaaaacccacaaggggccaggtatggtggctcacacctgtaatcccagcacttttggaggctaaggctagaggatcacttgagcccaggaatttgagaccagcctgggcaagatatccatctttacaaaaaaatttttttaaattagccgggcatggtggcatgcctgtggtcccagctacttgggaggctgaggcgggaggattgcctgagcctgggaatttgaagcagcagtgatctataatcatgccactacactctggcctgggtaactaagtgagaccttctctctttaaaaaaaaaaaaaaactaaaagacccacaaggatgaagagaccagggaatagacagaagcaacgttctggaagttggaaataagaaggatgagtggtaatttatttaacaaactaagactgtctgtgaggtacagatgtggccagaaacaaaagggaattagttggttaaaagcatatataagaaacattttacagccgggcgcggtggctcacgcctataatcccagcattttgggaggctgaggcaggcgattacctgaggtcaggagtttgaaacctgcctggccagcatgaagaaaccttgtctctactaaaaatacaaaattagccaggcgtagtggctcatgcctataatcccagctacttgggagactgaggcaggagaatctcttgaacctgggaggcaaaggtaacagtgagccaagattacgtcattgcactccagcctgggcgacaagagtgaaactctgtctcaaaagaaaaaagaaaccattttacatgataattgtcttgaatgtttcaaaaatggcaatgtcatgaaaagacaaaaaagagaaaggacgattttagattaaaggaatctgaacaacataacatgtaaagtcgggttctcaactggactcagcaacaacaaaaagctatattagacattcagagacagttgtggaaatttgaatatgtactatatatcaaatatttttattgacattatagtaaatctcttggacattcagaaagaaaacaacaattgatgaatctaaaagtgaagatatgtagttgtatattgtatgactctttaatttttctgtaggcttgaaattttgttagataaaaagttaatgtgagggaggtattaaataaaggagcagggaggaaaaagcggcagtggtgagacacctagatgagccttctcccttctgcatcagttcatcacccttcctacctacatcctcccccttcctacctacatcctcccccttcctacctacatcctcccccttggaagagctactttgctgcaaaggttgaaccaaaagattgtgaattcagggcaccagactaatttccagtagctgagaacagagagatacactgctttattggtgtatcagcaactctggctgaccgactttcacccttcagaccaaagatattgacttggctggatactctatagtaaacaccagttaacaagcacaaattaagaagcataccacaagaacttactaaaagaattttaatgcttaacctaaccatatcacttaaatttaactttcatatgaaggaagacctttttcattgaagattgtgcaaatattaacctacacagacacagtaacctctgttgacacattaaggcttttgaatcatgacattaaatttctatttcataatataccattttcaattttttaaatcagtgatcataaaataagtaaatattatgtagaaaaatacatttgactcaccctttgagtgatgtttaataaaattgttaaactaaacatgttagctttgtaaagatgcatcattataaaattttttttatttataaaaacagttctctggtaaaaactggaaaacctactagataaatttgaaaagggctgtaatgctctttttttgtatgacttttaatattgcccatatcagcctgtaatttactgagctataaattatgttaaacaaatataaacttatatttgaaaactgtcctgttcatggaagtttctactgattctgttgtaagtaaaagattttaaagttatcttaacattctggtaacactattcagattttggagtaaacctttctttgctgttggaacaggaagccatgcagtgtgtggaagagctgaatgcccagggcctactacatgtttttgtgagagtgggagtggagtccaccctggaaaggagccagatcaccagggatcacatgggccaactactctatcagctggtacagtcagaaaaactcagcaaacaggactttttcaaagggtcagtatcctcttcaagagtggtattcagttactaggctcttgggtaccagttaattttcaaagtacttacctctttaagtatttagttttttccatagatgaaaattgtatccactgtaatatgttgatatgatgcaattaatatattgatatgttggttgatgtgatggcattttatagattgtgctagggcataaaggttatcttttggttttctgaatattattgttagatctctatcatgttgtaagtaaggtaacagagaccccttagcctcagggaaactctgaggcctttagcagcccatttacatgtgatccccaaatgttctttgaggaaaaaagcttttctttgtgagaacaattctgaaaaattgtcttaaatttaaaaaccatattctttcaataaaccatggttattgtggctaggaagcacttgtgtgcccactctagcctcatggagaaggttatgtaacttggtgttcttaatgatttagtctatttcaggttggtttcattatgattcttgtcaatggatggtttgataaggtctgcctatctgcctgtcactggtggtgaatcctcatttgatcaggttctggtatatttgtgatataccatcatcacaagtacatggatcaggttccttgtggttcagccacaaaatcttacccaggcatagggtgtataaccaatgtttaaagtgaaaattgcattggtaaaaaattttgttttaggagccatgttgtatcaaatataaacacagagtcacacccagcactgacagatgcccactctctaagggaatagcaactaggatctcctaaggtctggacattggattaacatctgccatctcatcctcacctggacatatgcttattgaatcaaatggcagtaagaattctgtactacttgtaattttcctctttttttttttttttttgccaagctcatgttctcataaattaaatgcacatatgattaaatgccactgtatatttttccgtagtcatttcacatatggcaatccttttagaataaggtaaccattaaatgtcattgttggccaggtgcagtggctcacacctgtaatcccagcactttgggaggctgaggcgggtggatcacttgagatcaggagtctgaaaccagccacggccaacatgccaacatctactaaaaatacaaaaattagcccaacgtggtggcgtgagcctgcaatcccagctacttgcgaggctgaggcataagaatcgcttgaacccgggaggcagaggttgcagtgagccaaggttgcaccactgcactccgcctgtctcagtctctaaaaaacaaaaaagtcattgttgaatttattcgtttgactttgcaagcaatgacagcgttgtcttctaggtcctagaaaatttatacttgcccctaggaccattaaaaagttttcttgccaggcgtggtgactcacgcctgtaatcccagtattttgggaggccgaggtgggcagatcacgaggtcaggagttcgagaccagcctgaacaacgtggtgaaaccccgtctctactaaaaatatgaaaattaggctgggcaccgtagctcacacctgtaatcccagcactttgggaggccgaggcgggtggatcacaaggtcaggagatcgagaccatcctggctaacatggtgaaaccccgcctctactaaaaatacaaaaaattagccgggcgtggtggcacgcacctgtaatcccagctacccggagaccaaggcaagagaatctcttgaaccagggaggtggaggttgcagtgagctgaaattgcgccactgcactccattctgggcgacagagcaagactccctctcaaaaaagaagttttctttcaggctgggcatggtggctcacacctgtaatgctagcactttggaaggctgaggcaggaagattgcttgagcccaggagtttaagaccagcctgggcagcatggtgaaactccatctatactaaaaatataaaaattagctaggcatggtggtgtgcagctatagtcccagctacttgggaggttgaggcagaaggattgcacctgggaggtccagactgcagtaagccatgatcacaccactgcactccagcctaggtgacagaatgagaccacgtctggggaaaaaaaaaagttttctttcagcaataagctagattgctctgaattaaggccatttgaaccagttagtaagacactttggcaaaagttgctgtggttattggtttttaaggccaggatggtttcccagttttaaaagagaagcctccaattcagtccagtaactagccagtgcaaatggtaagagcaaataaaggtatgtacaccctcacaatcagattgaatatggtcctcccagcagacttgaaactataatttcctagaaataatactgttggagtgacgaggatatccatttataaatagttacttattacccagatattatgctacattcctcagaaaattctggaaatgataatggtaaattatcatttaccattttctgtctcttcaaactatactcggaagttgattcatatctataaagatgcccagaagcatagtctacctttattggctataattgaacttgtgagatactagcttagtctctcggatatctcagacatttgcatttctccctttgtgggattctctgaagaaaaaatatcataaccagacgtggctacagttttgttgttggtgttagaattgctgttgccggcaataattaccacactactaccttttatttagacataaaatgaggttaacacttctgtgtctcagcaattacttcatgtttcaccatacctgcttccgtctgcagctagaggcagtgcagtgactccaggcctaaccttcgatgcttagacctaaccagtcttggaccttagaccaagacatgtaaaagttgtactattttattctaaatggagaggcctgacaatttagtgccacctttttctaagagggaaatgtagggattgcttcatgtcagtgtccaccaagagctttcttgcaagcagatcagaatttcacaatcccttctaaagcctgagttataaatggttcatactgtctagagaggccatttcattggagccatgaagataccctgtcttttgcttctttattcttaacctacaaagatagtattgtccttccatagtattgtggaagagcctctgagatcagctgttttgggtgctgctactgcttagatgtcaacttctgaacagttggggaagcagtttctgcctagctcgccaagccaatgataactctgggaaggttagaaagcagaaagccagccaggcgcggtggctcacgcctgtaatcccagcactttgggaggccgaggcaggtggatcacgaggtcaggagatcgagaccatcctggctaacatggtgaaaccccgtctctgctaaaaatacaaaaattagctgggcatggtggcgcatgcctgtaatcccagctgctcgggaggctgagacaggagaattgcttgaaccagggagtcagaggttgcagtgagctgagattgtgccatggcactccagcctggcaacagagactccttctcaaaaaaaaaaagaaaagcagaaagcctccaggtatactggtccctggtgaggtagctactaatctgccatttctccctatagctctttagagtatgcactgctgcaaagtagtaaaatagacaaaagtttcaaataggctttatgaatatagcttttaggtcctttggaattttccttacaagatgttatatcaactgtgagcataatagttgctgtatgtgaaacatatctccgcaaagaaaacatcaagccatcgtcctgatattttcaggacttgaatctaaatactttatgaccctagttaggttggtaggtagataggtagaagcattattgtataggtacatgcacttcaaacagtgtgttgatagtctttttatatcatgatttcagaaaacttctttttaaaaactgtctagtaaatatagttgagtgcagtttgctgttagtcacagaactggaatgactttgaaagtataataaacaaatgaagaccaaggttgtaaaaattagagtggacaatagacacaaaatatgtaccctagaggaagattgatacattaatatttcactttgggagatgttttgttagagaggaaattcttatctcttccttgaatacttttctggaacctttattactgcttacggcaattctacattggtaaaagaccctatgtaggctggacacagtgattcattcctgtaatctcagctaccagggaggctaagatgggaggatggcttaaggccaggagttcaagaccagcctgggcaacatagcaagaccccatctgtaaaaaaaattaacaaaaaaattggctgtgcatggtggcacgtgccaataattacagctacttgggaggctgaggcaggaagattgcttgagcccgggagttcaagctgtagtgaactgcgagagcatcactgcaccccagcctgggcaacagagtgagatcctatctttaaaaataaaaaacactttgggaggccaaagtgggcaaattgcttgagcctaggagtttgagactagcctgggcaacatggtgaaaccctatctctaccaaaaaatacaaaaactctctgggcatggtggtgggtgcctatagctgcagctactcaggaagctgaggtaggaggattgccatactgatcttgtaaaatgacttgggaagtattttctccacttcaattttttggaagaatttgagaagaatttgttcttcttcaagtgtttggtagaattcagcagtgaagccatctagtcctgggcttttttttttttctctctgagatagggtcttgctctgtcacccaggttggagtgcagtggcttcatcgtggctcactgcaacctcaacctcctgggctcaagtgatcctcccatctcaacctctcaagtagctgggacagtaggtgcatgccactgtgctcagctgattttttattttttgtagagatggtgtctcactatgttgcccaggctggtcttgcactcctagacaaatgatccttccaccttggcctctcaaagtgctgggattacaggtttaaggcagtgcacctggccatgattcagtcttgatttgttgtatatatctatgagtttatctgtttttttctagattatccatttattgttcatagtagtttcttatgatcctttgtatttctgtggtatcagttgtaatatctcctctttcatttcttattttgagtcttctgtcttttctcctagtctagataagggtttcttgattttcttcatttttccaaaaatacaactccgagtatcattgatttttttctttcattttttaagtgtctatttcatttatttctgtttagatgtttgttatttccttccctgtgctaatttggggcttagtttgttcttctttttctagttccttgatgtgtaatgaatggtatattgtttgagatcttttttcttttttgatatagatgctcattgctatacatttccctcttaggagcacttttgctgcattctataagtgtcggtatgttgtgtttccattttcatttgtctcaagatattttttaaaaattcctttctaatttcttctgtgacctattggttgtttaggcagatgttgtttaatattcacatatttggatattttccaaggtttctcctgttaactgagttcaagttttattgcattgtgatccaaaaagatacttgatatgatttcagtcctcttaaatttgttaagtcttgttttgtggtctaacatatgatctattggggagaatgttttatttgcactttagaagaatatgtattctgctgctgtttaatggaatgttctgtatatttttgtttggtttaaagtataattcaagcccaatgtttccttactgattttctgtctagatgagttgttcattgtctaaagaagggtattgaggtcccctgctcttgctgtattgtagtctgtctttcccttcagataatcaattgccctatgtttttaggtactccaatttgaggtgcatatgtatttataactgttatatcctcttagtaaatggattcctttatcattacataatgacctttgtctctttttatagtttttgacttaatgtcctttttgtctcatataagtatagctacccctgccctcttttgatttctattttcatgaaatatctttttccttctcttccttttcagtctatgaatgtccttagtagtaaagtgaatctcttataagcagcatatggttggatctcatttttcatttatttattttttagattttgtgagagtcacactctctcacccaggctggagtgcagtggcgcaatcaaggctcactgcaacctctaccttctggactcaagcaatcctcctgggtagttgggaccacagccatgcatcatgatgcctggctaattttttttatttttttatagagacagattctccctacaatgcccaggctggtctccaacaactaggctcaattgatcctcctgccttgacctcttcaagtgttgggattacaggcatgagccattgcgcctggccggatcttattttttaatctatttagccactcagtcttttgattggaaaatttaatccatttacatgtgacataattattgatagataaggacttgctactgccattttgtaatttgttttctggttatttttgacaataccactttcaattgtggtagcattattttgcttttttgaaagatttcttatcagaactttactgcgttaaaatttttaaatatttttcttccaacactatgttgaataggagtggtgagagagggcatccctgtcttgtgcccgttttcaaagggaatgcttccagtttttgcccattcagtatgatattggctgtgggtttgtcatagatagctcttattatgttgaaatacgtcccatcaatacctaatttattgagagtttttagcatgaagcgttgttgaattttgtcaaaggctttttctgcatctattgatataatcatgtggtttttgtctttggctctgtttatatgctggattacatttattgatttcctattcaacatagtgttggaagttctggccagggcaattaggcaggagaaggaaataaagggtattcagttaggaaaagggaagttaaattgtccctgtttgcagacgacatgattgtatatctagaaaacccctttgtctcagcccaaaatctccttaagctgataagcaacttcagcaaagtctcaggatacaaaatcaatgtacaaaaatcacaagcatttcttatacaccaacaacagacagagagccaaatcatgagtgaactcccattcacaattgcttcaaaaagaataaaatacctaggaatccaacttacaagggacttgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacatcaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaaggggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataagaacacttttacactgttggtgggactgtaaactagttcaaccattgtggaagtcagtgtggcgattcctcagggatctagaactggaaataccatttgacccagccatcccattactgggtatatacctaaaggactatgaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggagaatatcacactctggggactgttgtggggtcgggggaggggggagggatagcatcgggagatatacctaatgctagatgacgagttagtgggtgcagcacaccagcatggctcatgtatacatatgtaactaacctgcacaatgtgcacatgtaccctaaaacttaaagtataaaaaaaaaaaagaaaaagtaagatgattggaaggaaaacaataaaatgatccttattttctggtaacataaaaaaaaaaaaagaaaaatgcaaaggcaaagaatcgatcaggttggcagaagctgttccctggcttatgggcaggagggagctggtgaggctttggaaattctattgctaacactaacacgggagatctttctggcctttctggttttggcaatggctctttttctcctgccttctaaggtactacaggaaaaaatatttcctctacctccatcccacattgcccaggaacattttaaagattgaaggctttctcaaaaaaaaaaaaaaaaaaaatttaatatttttcttttaatcatgtatccctttcttcaattaaaattttacacaaaaacccagtaaataaaatgaagtggagcttttgtagttgaaatgggcggagggatatctgcagtctcatctatgtagaccttaccaaagttcagtccagtggctgtggttttttccttccacccaaagaaaagcctgacagtccaatgactgtgatggtcactacatgccaagaggcaagggtatgatgtagctctgtttcattttttcagcttttagaaaataacgtgtggtgcaaagcattaatataggctatgtagtagtgcaaagacataaagacagttattacctaggtgcttcagcacactcaagatttttcttttagaatcatgcaacaggatttaagaactgtaaacctgaaaaaaaaataagcttcttacaggcttgttctatggaaatcctatgttcagccaaaaaagttttttgttagcagtatagatttgaccactgattgtgttctgtggactgtcccatgatgaactgactgatcaaggcataaaaaaccaaagcaagaatatgggtatattttatttgtaatgagataaaatatatgagataaaaatagcagcaggtacactgctgaaagaccagcatggctacagttgtctcttgggcccattaaacagcttaatttatgctgctagcccacagagcatgagttggcaggatcaggtggttaacctagaaatcctggagtccagctagattatatttcatcagtggtacattaactgaacccaaagtatgcacataatgagagaacctgcaattatttgacatctatttgccatagcacagacaccgtcctcggcatcaaataattgcaagctgtgaggtcagaaagttggaattaaggattcatgaagcccagagttagataatatggctgagctgcaaactgttttgaagtggcagcttcagaatggtgaccctgcctatggtggtagctctttttaagtgaaaagttttagtgagatgtaggcctctgaaaaaagggtggcatactttggctagaacctggaactgcagtggaaaagcacacgttttacaattgtagagatctgaaagggcatgcatacaattaccacctgctcttagctcttcaattcattcctccctttccttatgacttgcaattatgtgtatgtctcctgtagttaaattcatttgcttttgtactttattatatattgtatgtggaaataattaacaaagtcttgagttgtttgtttatacttccaaatgaacagctatgatttttagcctacataagagtgctggtattttatatttgattttcctaagttttatatttaattcccatttgcttgacattgagaaatatttataattcatagcacaaaagcctgaaaccattagcttttctgtagagatagaacagttcgtaacatgtaataatgatgatagtgttagtaatgttgccagactcttttatatccatccagttttttccccattgtaagattcctcaaggacacagatttttgtgttttacagtaagtgtttagtcagtgcttttgactgactcagagaatatgatattcaactgtggtgaattctttatagtgcaggattaaatggataatttttcccctagaacttcacaggactgtccttcttttcatcatttaaggctttcaaatgtcacctttatatggaggtattttctgacctccttcttgtacatagttcatgttcttcagagtattagccctatttgcaagtatgcttttgtctgttctagtctttttcccccacgctaacataatctctttgagaatggtaatgtatttaccagtcactttgtggctagactgtacctaacatagcaggtgattaatatgtatttgttgactgattttttatctctttatttaattttaacttttgaattacatttgcatgtgatttttaccccctgttccttttcagtttttcagaaactttggaattggcagatgacatggccattgatattccccatatttggttgtaccttgctgaactggtgacccccatgttaaaagaaggtggaatctccatgagagaacttaccatgtaagttatacttgtttctcttgatatatatcaggtagaactgactaataactcacttgctagctctctatcatagtactgtcccattatcgcctttggagactcatgaatgcaggctgtgactctttaagacttctgatttcagtgtaaaaatgttaccttatgctaggtctacacctgagatattctggggatatgatagccctgtggtctgttgagggtagtggcgatgatagattggctccagaatcgtgtaactggaagatgactgcttctagaagcttaatgttcatctggcttttgtgtctatcattgcagtagtgctgtaagtagttatattttcccattgtaacttgtcagactgcattaccccatagtacatgctcatgattataataaaaggatgattataataaaacaaactgagatctcaagtattcctacatttggatgtgagtggggaatggatgctacgttatatagaccggtggttcccaaactctgttcttcgaaacactagtgtttccacaaaagttgtttatatagtcaaactttgcacatggtcatgtcccttttctttgagattaacaaaacatacttagcatattaaagtttatgacagtcctatagtaaagcaataaataaaaactagttagctttgtttaattcagcattgcctcacttagagtatagatatcctatggaacacagtttggtaaatgctgatttagactgttacaaaattggcccctttgctgtttcatccataatttcatctataaagaaaagcttcctttcttaaaaatactttatatatggccagacgcaatagcttacacctgtaatcccagcactttgggaggccgaggcaggcggatcacaaggtcaggaaatcaaaaccatcctggccaacatggtgaaaccctgtctctactaaaatgcaaaaattatctgggcatggtgttacgtgcctgtaatcccagctacttgggaagctgaggcaggagaatcgcttgaaccagggaattggagattgcagtgagccaagattgcgccactgcactccagcctggcgacagagtgagactctgtctcaaaaaaaaaaaaaaaaaaaaaactttataaaagcatcacaactccctgttacctaaggtgcttctcattttagcttgaagcagaacttacataaacaaacagattaccacatctgatctttgtgttgcttctgtcactgaagtggttaaagaaaaaggtaaaaaccaagaactcacatgtaccttttcaggaacttctcctgaaaatgacttagagcatgtcctggagctttggcttgcccagtattatgtaggttgcacagtatctggtttttggtcacacattgtttgcctcttgttctagaagaaaggatttctttagagatacttaatcactgctcctatcttttacagagaatttagcaaacctttacttcctgttggaagagctggggtcttgctatctgaaatattgcacctactatgcaaacaaatggtgagtgttacactgagtgtcagactcaacagtattattaggaagggcagtgatcttgatcttgggttatctgtgaatagcttaggtctcagggtgcaagtaattaagaatgaggtctctgcttcaacccagtttctttctgaggtgcatttgtccttctgtttgctaatatcttggggcagaattatcaaatctcgactagatttggtataattctaaagaatctcaagtcatgttttatttgtagttgattttttcttcctttgaaacaaaatggatatatcatttatatgttttaatagatttcaacgaaaagctccatagagctggaggctgtcagtctatggcaggctgtcagtctataaagtgggaacagataaatctaaaccaataatttcaaaagagtgaaagtgctttgttagaagtctaagaggtttggggaagtgttgtggcatcacaaagggaataaaatgtctaggatgagagggatgagagatgtcaaaacaaaacagaactcagaaatgaagattctggagtgatttctgacttacttacgcctgactcaaagatattggatgatagattttaatgtttaaagtcagtgtttcattcctccctctgatacagaagtccttctgtatcccatttgtgtggtagttattcataaacagatgtactaaatatcctggtctctagttctgttgactatttgttaatactactctttgcttaatggcactaaaatttttactgaaccctagtttttatgtccaaaatttcctcctctccgacctacttgactttagtccttatttaaaactcacattctggccgggcgcagtgattcacacctgtaatcccagcactttgggaggccaaggtgggcagatcacgaggttaagagatcgagaccatcctggccaacatggtgaaaccctgtctctactaaaaatacaaaaattagccaggcatggtggcacgcacctgtagtcccagctacttaggaggctgaggcaggagaatagcttgaacccgggaggcagaggttgcagttagccgagatcatgccactgcgctccagcctggcaacagagcaagactctgtctcaaaaaaaaaaaaaaaaaaaaaaaaaaagaaagactcacattctggctggcacagtggctcacgcctgtaatcccagcactttgggaggccgaggcgggtggatcacttgaggtcaggagttggagaccagtctggccaacatggcaaaatcccatctctactaaaaatacaaaaattagccaggcatggtgacaggcacctgtaatcccagctacttgggaggctgaggcaggagaatcgcttgaatctgggaggtggaggttggagtgagccaagattgtgccactgcatttcaacctgagctacagagagagactctgtctcaaaaattaataataataactaaaaactcacattcttactaactttgatgtgtagaaacagcacaaccctacttccaaataaaactaaattctcatatagtataagctttggagccagatggccgagttcaaattctggttcaactatattttcagctatgccttggacaagttactctatgaagtaattaatacatacctctcagatgacagcaacagcctcaaacctggcattttccgttgtcactgtaactttcttcaggtagaggacttgtacctcttcacttttttctacctgacaacagctcttctttattctctctcttgggctcaaccttgtgcttcttgcccttgaaacacttctcattcctggttcaggagcaacaactgctttaagcctccttgtatcaggcagcatggctgtgatctattatgaagagggattctagtgaggcttcttgaatggctttaatagcagatacatacagagctatctaggaaaagacacagtgtggaatttataaactctgtgtattggactttttttgatgtttataaatcccaaataaccagctgtagctccccagattagtcacctcataaatcaattatttaatcttaagcagctgtacttcaattattcaccattgtatttatgtgcattcagacatcttagtttgaaagtcacaagtcttaagagattaactttttatcagtgaggaaaagtttgttttcgagactggtcttgctgtgtgtgttgcctgggccagactcatactcctgggtgaaagctgtcttcccacctcagcctccctagtagctaggactatacaggtgtgcaccaccatgccctgctggaaacgttttgatttttcagctttttggggtttgcactgtttgacttcaagcaaatctttttttttttttttttttctgtttcttcttccactgtgaaagtaaatggattggatttatctctattttagagccataagaaagtgggagccttatggagggaggctgacctcagctggaaggactttttaccagaaggagaagatgtacataattttcttttggagcaggtaagaacaaggcttatgttttgctgtttgatagtagttgatctatttcatagaggaagtgaaggtaatttccttcgtattccagtcgttaaaattgcatcaaaataggaatcttggtaaagatgtccttttaagttcatgcttttaaagccactccaactgtgtggtcatcagatgattgatatttaaaaaaagaaaatgtaaaagacttagcaacctatagaaaaacaagctacagcaagcagaaatgaagttaacaaataaagcagggtgacagggccaaagctgtctcctgatttctgggtctgatggcaggccagaagcagccagaagttattctgtggggaatggagaccattaatacccttataaggtagaagattagagacaagcttatagcttgaaactacacaggtaaataagtgcaaggaagtagacacagtcttatacccagaaccttagctatcctgcctactgactggtaactagatccagaaatctacaaaacagaagaccccatgatcagtataatctggtcctataggaggatttgtgggctgttaggttgaggtaaccataaaacaaattagatcaagaaaagtaacagaaagaaaacaaaactctctcaaaacgttactgaaaatcaaaatcctaaaactcatgaggaaaactaaagctaagacagccaacaaaatcaggaataaggagaaaaaaaatcaccataggtaaaaagagaacaagaatgcaatctgaaaatgactttaaaataagtattttgttctggataaagatattatattaggttgctacagacattagctttctttttggttgtagtctggaacactgaagagcattcttgccacagcaataagaacctgcatgaagcataacttctgatgtgttactggacttagaagaggtggaagtaatttccttcaaagggacaaaaagaattaatgagggggaaaagccagagatgaaacctgaactgtgaatagtaattacatgtgaagggcatattgcccaaaggacacatagcccagtgggaagatactattacaaatgctgtcagatgtcatggaaaaagttgacttagtcccagttcagtattaccttggctcccagaagcagcaaatcaaaatgctctttggagaaacatcctcaacttaggtccccttattttctacaaatccaaattatttaaatatatgagttgacacttggtgttcatttaacatacaattaaagaagtaaagataaaagtaaacagacaataagtagtagatttagaccccatggacttgaggtaatggaattatcattcagagtataaaataacactatagtaaaagaaagaatcacaaaaatgagcaaacaagagactagtcaaaatggttaaagagatttgaaaagaaaagaaaaggttgggtgcagtggctcatgcctataatcctagcactttgggaggctgaagcaagagaatctcttgaagccaggagttggagatcagcctgaacaacatagtgagacctgtctctactaaaaaaaaatagctaggtgtattggtgcacctgtagtcgtaagctactcgagagactgaggcagaaggatcactagagcgtgggagtttaaggctgcagtgagatacgatcacaccactgcactccaacctgagagacaaagtgagagcctatcaaaaataaaaaataaaataaataaacaaaagccacacacacacacaccaaaatctgtaggtagctatctaagatatgttaatatgttaggagatttggaggaaagaatgagagaacatctaacctatctaattggagtcccagaaggaaaattagcctaaatggagaagaggcaatatttgaagagacagtggctgagacttctagaagtgataaaatatacaaatctataatgaaagcccatatatgcaatacaggataattatattttagtgaaactgcataataccaaagacagatgaaagattttaaagaagctgggaagaagaagcacattacttacctgcctccccctcaaaaaaaaaatacacaaaaaattagactttgcagtagcaaccatgaaagccagaagatggtagaataatctcagagtgctgagaaacgagcagtaaatgtagaattccctgtgcagctgaactaacctttaagaattagggcaatgcatactgagaaacttaacaacatacttctaaatacccatgggtcaaagaagaaatcaaacatgatagtaaaaaacatttttaactgaatgaaaacaaaaccacaacatatcatcgatatttagaaaagaagaaaggtcaataacctcagcttcaaccttaaagaattagaaaaataaggccagacacaatggctcatgcctataatcccaacactttgggaggccaaggcaggaagattgcttgagcccaggagcttgagagaccagcccaggcaacagagcaagaccctatcaccaaaaaaaaaaaaaaaagaaattagaacaataagaacaaatgaagctccaagcaaatagaataaaggaaataataaacattatatcagaaatcaatgaaatagaaaaatttttagagaaagaccagtgaaatcaaaagctggttctccaggaggtggaggttgcagtgagccaagattgcaccattgcactccagcctggacaaaagggcgagactccgtctcaaaaaaaaaaaaaaaaaaaaaaaaaaagctggttctttgagaagataaaagtgataaacctctagccagattgatcgtgaaaaaaagtttgaaaagaaggtacatattactaatatctggaatgaaagcggtaacatcagcacagattctatacataaaagtgggtgaggaaattttatgaataatctttatgtcaataaatacatcagccaggcgtggtggctcatgcctataattccagcactttgagaggccgaggcgggcggatcacgaggtcaggagttcgagaccagcctggccaacatggtgaatccccgtctctactaaaaatacaaaaattagccaggtgtggtagcacacgcctgtaatcccagctactcaggaggctgaggcaggaaaattgcttgaacccaggaggcagaggttgcaatgagccaagatcacattattgcactccagctctgggtgacagagcaagactccatattgggaaaataataataataataatgtagggtttatcctagaaatgtaaggtgggtttaatatttgaaaactgatgtatacataatagggaagatggtgaagtatacataatagagaagtatacataatagagaagtatacataatagggaagatggtgaagtatacataatagggaagtatacataatagggaagatggtgaagtatacataatagggaagtatacataatagggaaggtggtgaagtatacataacagaagtatacataatagggaagatggtgatgtatacataatagggaagatggtgatgtatacataatagagaagtatacgtaatagggaagatggtgaggttccaggattcaatccctccactgacacaactattgaactggcaagatctgttagagccaactgttttagaactgtggagtctcgttaaatacatgcattatcaacaccaggggattgcataatgaaaaaagagtctgataaatttcagtgaatttgggaattttgcatagaacttaccagtacccagcccagtggcagaccaccaggaaactggcatcacaccatttctggtgcagcttgctggtgccaggttgaacaataaggacttcattttccaaggattggggttgtgtcttttaattgacttttagttgactgagaggccagtgctggggctggctgttatttcaactctttcatgctgaagtatcttttagggctgtgactatcaaaagtatttaagcagtagtgttaacgggatctctggagtgtcgatttttttggccagaaacctctgtggccatggcacctttgcccgagttcttttcctgtgtccaggaagaatgaggtacgcaaacaaatgaagggtgaagaagagttttatttagtgttagaacagctcagaggagtgggtagctcctctctagtaggcaggttgtcccatggagtgttcagctctctgtagagaggaggctctggagaggatagctcctctccacaggcaggtcgtttggacatttctgcaggtctctgaagctctcagaggagagggtacctcctctctcctggcaggtcatctctgcagctctcagcagagaaggcattcttctctgcagctggtcctccaatcgtctctctaccctctttgtcctctgcccatctgctaccctgttctggctgagtccagggcttttatacctcagaggggaagaaatgcatgccaattggtccataggcagccatggttgggcctggaagaggcaccatgagcccctactccactctgctggactggcatcccagcccccagccttcaggtcctccctggcctgagggtggggccttactggggaccctgcccccttccacccaggactctgtctgcctcctgctgccattcatggccctggggcttggtcccaaccccactccaagatcagagagcaggcaactctgagcctgcagggacagggggtctttcctgggacacccgagggtgctgactgcagagacgcccaggtgctgcatgcctaggagggcagccacagctgcaccccagagctcccaccccaccaactcagaagaggcagggctcccccttttcccgtcccctgcctgctttgtggaacgggaggcccaggtctgcagccgcaggtcaggcagctgcgacagcacccaggaggggagatcctgcctgctccctcaagaaaggctcgaatccacagctgcagtttgggtgggagggcagggctcctgcctgctccaaagagcaggaggcttgggtccgcagctatggtttgggtggctgcagtagcacaggcagcttccatcccaactcagaaggggcagggctcccaccggctccatgcagtgtacggccccagctgcacctccctgctgcagccaatagtatctctctctctgtctctctctctttctttctgtctccagtctctctgtctcctctcctctcccctctctcctctttcctccttctccactccctctccctgagtcctctttttttgttaatttaacttttattttaaggtcaggggtacatgtgcaggtttgttctataggtaaacttgtgtcatgggggtttgctttacagattattttgtcacccaggtattaagcctagtacctattagttatttttcctgatcttctcccttctcccaacctctgccctctgataggttcgtgtgtgttgttcccctctatgtgtccatgtattgtcaccatttagctcccacctataagtgagaacacgcagtatttggttttttgttcctgcattagttcgctaaggatcacttggcctgggaggtcaaggctgcagtgagccatgatagtgccattgcactgcaacccgggcaaaagagcaagaccctgtctaaataaataaataaataaataaataaataaatatgagacttcagtttaaaagaaaaaaaaagcaatcggaggtcaaggctgcagtgagccttgatagtgccactgcactgtaacctgagcgaaagagcaagaccctgtctaaataaataaatatgagacttcagtttaaaagaaaaaaaaggcaaaataatatatatataataaaatgaatatataaaaatgtttatagtttgaaaaatgaggttgaaaaatacttggcctgtatcttgacttacagtttgcttaaacagcttatggccttcatgttgtgcttttttgcatatattggagcatcatggattggatgtatagttaaccaatactaaatcagaaaaattgtaatattgagccatgtttctaaaatcttatggagctgggtgcagtggtgcacactgtagtctcagctgctcgggaggctgaggcagaaggatctttgagccccagagttcaagtccaacttggcaacatagtgagaccccaagtcaaaaataaataaataataaaaccttattgggaaatataatttagagatgctacgtaagtggtagaaacggaacaatcagatgacagaactcaagactgtggttttcactttgtggattggggatagggtataggaccataccagagtattcaagagtattagagaaaaccttatgtgagtaatccttaatattttcatctttatggtttttgtataatgaagccacataaagcaaggcatacctatgtacttcatttctttagtcctttgaaaattatgaataattttgattatagattttttttttctttttgagacaggatctcgccctattgccaggctgcagagcagtggcacaatgacaattcactgcagcctcaacctcccatgctcaagcaatcctcccatctcagcctcctgagtagctgggaccacaggcgcatgccacaacacctggctaattttggtatttgtgttggtagagacggggttttgccatgttgcccaggctggtctcaaactcctgaactcatacactcctcctgccttggcctcccaaagtgctgggattactggtgtgagccactgcgcccagcctgattatagattttttaaaactatgtatctaagtgctaaacaattatagcatcatttctcacacctatattcgaaatggccacaacttaacaaagccaaaactatctagttttgatagctgctgagtaccaatactaatattaaaccataggttgcagaaagagagtgaaattgtacccttttctagggctcctatcctgccttaaagagctatgttgcagctaaggggaagattgaagctcaagattatttgcgtgtaaccatagcctagagataattatagggggttattaccttcttttttaagatacacggtatgagaagttggaaaaatattcagaaggataatggactgacagtttttcaaaactataatacgaacaggttgggcgtggtgagtcatgcctgtaatcccgtctttgggaggccaaggagggcggattgcttgagctcaggagttcaagaccagcctgggcagcatggcaagaccccttctctactaaaaacacaaaaaaatagccaagtgtggtggtgtgggtctggagtcccagctactcaggaggctgaggtgggaggattgcttgagcccgtgatgtggaagttgcagtaagccaaactactccagcctggatgacagagcaagaccctgtctcaaaaaaaaaaaaaaaaaaaaactacaaacataaaatagcctctgctgatcattttgattccatgtaaaatagaagacgtaacctatgactttgttcttctctcaggatgacaataacatagaattatattaatatattaatatgttccaccttttatgtttcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggtataaagactatgtcaccttccctgatacctctacaggaaagattcttgtgggatccccttaattcgcttacctatcagttcacttcatgaatttttattatttatttttttttatttatttatttttttatttatttatttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacgtgtttcagagagcacagggttggggttaaggtcacagatcaacaggatcccaaggcagaagaatttttcttagtacagaacaaaatgaaaagtctcccatatctacttctttctacacagacccggcaaccatccgatttctcaattttttccccacccttcccgcctttctattccacaaaaccgccattgtcatcatggcccatccccaatgagccgctgggcacacctcccagacggggtggtggccgggcagaggggctcctcacttcccagtaggggcggccgggcagaagcgcccctcacctcctggatagggcggcggccgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttcaagggattctcttgcctcagcctctgcctgccaccatacccagctgatttttgtgtttttagtagagacacggtttcaccatgttggccagattggtctcgaactcctgacctcaggtgatccatcctcttcagcctcccaaagtgctgggattacaggcatgagccactgcacctggcctgttttttgttttctcaagacaaggtctcgctctgtcacccatgctggagtgcagtggtgcagtcattgcttactgcagcctcaaacccttgggatcaagcagtcctcccaccttagtctcccaggtagctgggaacacaggcatgtgccaccatacccagctttttttttttttttttttttttaagagatagggtcttactatattgcccagactggtctcaactcctagcctcaagtgatcctcctgtctcggcctcccaaagtgttgggattacaggcatgagcctctgtgcctggctgagcaaggtatctttaattgttttatttctttttgacttcaggctaatctagacgaaatccagatgagttcacctacattccttagagctttaatgactgctgtttgtaaagcagctattataggtaagtaacatttctgaaggcagctcataacatctgaaatccccattatgtcaactactaagtatacagtttgattttacattgttttcaaaacttctcctatgtagctcacttttctgtgcactgtcctttctgtctgtgatgcctggttgtctcaagcgtggagacaaatagctgctccgcctacagagaacccagatctaaccagctaccacatgccttgcatgctccttgggttgtttttcactacgttgcgtgtagctttttctttatcttttcacttctaacattcagggccgcctcctccttccaataatgaattataatgaacaggttgaatattcttaatctaattatcagtatagggttattctcatcaaaaaagtcatgttatataagtacatacatgaagaaaaaaatatcaacagtttgtcctgttctttgttgactttatttgatatgataagacaattttattggcttatgaattgttaatattgataggattagggtcagtagaaatcccaaatattccaagctgtatacaatgtttaacattattcaatgaagacatctctttagtttcagatagaaattcatacttctgtcactgaagcgagaaaaaaaaattcatcagtgcaaaggtgtctcagaatttcaagtctgtctctattttgaagatggctttctgccacttaatatagcttcagaattgtaatttaagatttgcaatgaatttattttcaatgttctttaatgagataaataacaaagctaagtagaaagtcttcatgaaatttttaaaaatcattttcagtatccatagaaccatcataagactttcatgttttaaaattcgagttgggaagtccaaaagctgtttggtttttgttttcttgagatggtgggggtcactgtgttgcccaggctggacctgaactcctgggcttaagcggatcctatcgcctcagcctcttgagtaactggaattacaggcatgagccacgatggccagattttaaaagcaaaatctgcttttaaaaacaaaattgtgtcttagtgataacttacagataatataaacccgtatgtgtctttgtactgaggatgcttttcatttctcagcccctttttatcattcctttccctcaaaaggcctagattaggtatgttatctgccactgccacagttagtttttatcctagtaataacaaaatggttccaattattttagccttctgaaaagatttgtattaagtgtcactttaatttccttttctaatgttgcttttttatgttgctttttttaaatactcacttgaaattcctactccatgtttcatttatttttgattgacaaattataattgtatatgtttatggggtacaatgtgatgttttgatatacatgtccaatgtggaatgattgaatcaaattaattaacatatctatcacctcacttacctttttttatggtaagacatttgattaattttgcttttgtagtttgtcataaaaccacagtcactgtttcattacaattaaagataattgggtacgctactcctgagggaaaccagcattcaaaatgcatcccctccatagtttttattatttgtgagagaatgtctcattaataatttcagagcattttggatttcaaaatatttgccttagaccttcttgcctcctcttctcttgtagagccatatgggtcctttgtactcagaaaattgaaaatgagccaggttgcagtggctcatgcctgtaatcccagcattttgggaggccaaggcagaaggattgcttgagcccaagagttcaagaccagcttgggcaatatagcgagaccctgtctctattatttaaaatctaaaatagaagaagaagaagaagaagaaaggccaggagcagtggctcatgcctgtaatcccagcagtttgggaggctgaggcgggtggatcgcctgaggtcaggagttcgagacaagtctgaccaacatggtgaaaccctgtctctgctaaaaatacacaaaaaaattagtcaggcctgggagcaggcgcctgtagtcccaacaacttgggaggctgagacaggagaatagcttgaacctgggagacggaggttgcagtgagcttagattgtgccactgcactccagcctgggcaatagagtgaggctctgtctcaaaaaaagaaaaaagaaagaaaattaaagataattctatgttaactccttaaatgtaattcctagttcttctatcacctttagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccagtaagtttatctcatgttacagttaatctaaccaatgagtgagatttatccaagccaggacttagagatgatttagggttcgaacaaaggacaataaaagaatcactaataacacaaactcatataactaactttaataaatttgaatttggccgggtgcagtggcttgcgcctataatcccagcactttgggaggccacggcaggcagatcacttgaggtcaagagttcaagaccagcctggccaacatggtgaaaccctatccctactaaaaatacagaaatggctgagcacggtggctcacacctgtaatcccagcactttgggaggccgaggcagatggatcatgaggtcaggagatcgagaccatcctggctaacacagtgaaaccctgtctctactaaaaatacaaaaaattagctgggtgtggtggcgggcacctgtaatcccagctacttgggaggctgaggcaggagaatcgcttgaacccaggaggcggaggttacagtgatccaagagcatgccactgcactccagcctggcgacagagcgagactctatctcaaaaaaaaaaaaaatacaaaaatacaaaaattggctaggtgtggtggcatgtgcctgtagtcccagctacagctactcagaaagctgaagcacgagaatcacttgaacctgggaggcggagtttgcactaagccaagatggcgccactgcactccggcctggacaacagagcaagactctgtccaaaaaaaaaaaaatgaatttgttatatgtttgtatgaaaatatcacaacaagaaaactatttagattaggttatttcatccccattccagggcaggcctaataaaactttccacagtgatggtagtatatatccataccattgagtatggtaatcatgagccacatgtggcaattctatacttaaatatgtctgttgtgacttaggaactgaattattgactttaaatttaaataaccatgtttgactaatagcttccatattggacaacacaggtctagggcatgaaaatggttaatgatgttgaggatgatactctagaatctttagacacccaacaaagaccctaagtgtagtgtatttaccatgctatatttactaaggagtttcagaatagtttttagttaagggttatgattaattcttggctaatgaaacaaagtaacctgtacacttaagtcttagtgatacttggtgttaactaatgatttttattacatcttgaaaattcagttggtatttgttaaagcgggcagtacatagctattagagagagcactcaagtagttctttggtacttccttattttcgcttttgtaaaattccttctttcctagtcctgaatcgctcttggagataaaggaaaagatgaaagcaaattatccttatagtgtaactgaagagacaatctaccatgaatcagataatttgataatattagcttaactaatataattacaaagataagtctttttaaaaaaaggccgaggcatgcagatcacccgaggtcaggagtttgagaccagcctggccaacatggtgaaaccccgtctctactaaaactacaaaattagctgggcgtggtggcgcatgcctgtaatcccagctacttgggaggctgaggcaggagaatcacttgaacccatgaggcggtggttgcaatgagccgagatcatgccactgcactccagcctgggcaaaaagagcaaaactccatttaaaaaaaaaaaagttaatacgactcatgataaacctaatattgattagcatttattgtttattccactgcctccctccattaatataaatgatcggagagctgactataataactataagctaataacttattatatatgataactataattctcagttttactatgagagtaaaaccgagaattaaaatcacacggatagtttggacgtttaaaacagtaaataacaggtgtagtttcactggataaaatccagatgagatagcttttactcatgttttccatgtgaatgatcacctctttttcttttttgagacggactctcgctctgtcacccaggctggagtgcagtgatgcaatctcagctcactgcaagctccgcctgccgggttcacgccattctcctgtctcagcctccctagtagctgagactacaggcacccgccaccatgcccggctaattttttgtatgtttagtagagacggggcttcactgtgttagccaggatggtctcgatctcctgacctcgtgatccgcctgtctcggcctcccaaagtgctaggattaaaggtgtgagccaccgcgcccggccacctcttcatttttaaaacaacattacaaggaataaaaagcatatcctgcctttctcccttcccccaaattttgtaaaaataatacagtaaacttgcagcgcagaaaatagtcaaaagaaagtaaacaactactcgtatttaaattttatagggtttagattgagataaacatgatatgaaacagcttcactggtatcagaagatagttcagattgggccgggcacggtggctcacgcctgtaatcccagcactnnnnnnnnnnnnnnnnnnnncgtgtacccagctcaacggtataaaccctccgcatgccccctatcttacaatacccctatgacagcgtcaccatggtaatgctccactaaagccagaggggacgaaataccttatctacctggaaacgccggcacctcgagaccacgagggattacttgtgactaagcggataaaatgggacagccctaggtattccggtcacctaggttcaccctcccacgttatacacgatacaaggttgaactatcacagtaattctaaaaattagccattacagaagagcaccaatattgtcacaggtacctctaaggctatatccatcttcgagcccttactagagcatctttagaaaagttcgaagtaacttacatgaaagtacagccgcagatgtgcaatcaactgatgaagcaagtgtcaggacttactgtgacaccgacgagcggctgaaaggagttattgacctgagctttgagaaggctattgatcgcgcccggccacctcttcatttttaaaacaacattacaaggaataaaaagcatatcctgcctttctcccttcccccaaattttgtaaaaataatacagtaaacttgcagcgcagaaaatagtaaaaagaaagtaaaaaactactcgtatttaaattttatagggtttagattgagataaacatgatatgaaacagcttcactggtatcagaagatagttcagattgggccgggcacggtggctcacgcctgtaatcccagcactttgggaggccaagatgagcggatcacctgaggtcaggagttcgagaccagcctggccaacatggtgaaatcccttctctacttaaaatacaaaaattagctgactgtggtggccggcgcctgtaatcccaggtacttgggaggctgaggcaggaaaattgcttcaacccaggcaggcgcctgtaatcccaggtacttgagaggctgaggcaggaaaaattgcttaaacccaggcaggcgcctataatcccaggtacttaggaggctgaggcaggaaaattgcttaaacccaggaggtagaggttgcagtgagccaagatcgcaccactgcactccagcctggggacagaacaagattgtctctcaaaaaaaaaaaaaaaaaaaaaaaaaccagaaaaaaagttcaaattgtacaaaataataggaataaaaaagaatttagactgcttcaatctttttttcctcttctttaaacaagttgttgggctgtttatactgtcaagagcaagtatggtgaattgtcattattgcttttttctgggggaattaatgcacatttattcagtcattcattattttgaaatatattcttttcctcataactacagtgtcccaaagcttatagtttattttcacctccttgcagatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaagtgacttctcctttggacagctgctgcatgtgtgcccattcctgggggtgctgtctggctatttattgtctaattcaaatcactcctgaggggagagagataaaacgagagagagtgagagagtgtgtgtatgtgcgtgtatgcgcacgtatgtgcatgcacatgtatgtatgtatatgtctctactcactgaaaaggcaagctactttgtgggtaaggagggcacttgtgcttgggtgggaatgccccactgggagtccagtgaaacttgtttccaacactaactaaaaatgcattcaggacagtaggcctcaagggcagtcctttagataactaagttttccactctgtgtatcaggactcaggacaataattcactttgagactgccactaccactgattttaaaatcttccatcaattgcctgcaatgcttaagaaacccaaagatgtcctctaaagaatgaataaaaccaaaagctatattatgcttttacaaaagtgggggtgggatttttataaaagtgggggtggggtttaaaatcaagccaataccatgtatgcaaatcacattgtctgccaactccaacctcattcaagccattctggtgagtataaagctgactgtgggcctctgcttgggcctctgcttctcctacagatattggagtgctgtgctttctaattttcccaccctttcatgaagtcgcagtctctacagatggttttccatttcagttgtttgtgggccatcaacctacaaaatgtatttatgaagaaagccagactactcccagataaatagtctttttcttttgtatctggataacaagagatttctgctggcttccatctctgaagaaataccacattaagagacttggcaagacttgtgaaacacaagaacaaaattttctatagcaataaaatgtttctctgaagtgtagttgaacacaatacaagatcccactacataagcccacagaggccatttttcagtggtggaatgctgtatgccactggtccccaatgcacaacctagatccctcacatgtgcagttcacaatgggttcgcgctcctgtgagaatctaatgccaccactgatctgacaggaggcggagctcaggtggaaatgcttgctcacacaccactcaccttctgttgtgcagcccagtttctaacaggccatggaccagtacgtgtccttggcccaggggctggggacccctgctgtatgctgcttttgttttgttttgagacagggtgttgctctgtcacccaggttggagtgcagtggcttgatcatggctcactgtagcctcaaactcctgggctcaagcgatcctcctgcctcaccctccccagtagctgggactacaggcacacaccaccacagaatactattgttgaaggaccaagtcctgaaagtcttttgaagggtatgcgacagcatcagctgtaaaagatggggcctgaaaagctgttttggagcctgaccacaggctttgcctgggatccctcaattgggagaagcagcctggttctatgatcaactgagtaaacaacctccagaatcaaagtgcagaggattatgatcaaggaatcgtctctgagtgatagaagtttttagaaggtattgacagcactcaagaggttgagggaggggagtttaggggaatacaggatggtaactgcctcttgagaatcagtagctgttttttgcaggggtctgaccagggagggatttcaggtagtagagatggcctagttatcagtattttacatattaacaagtgtaaggaatggaggaaagagagaaatatttttgaaagaacaattaaagggttgaaaaatatcttaagatataaacatctctagtacaatgacagaaataatgtttgaaatcttacctataacatgaagtatgttgaagagactacaaagtaagctttgagtatcttgttgctgtggacacggaatgtgtgctaggattagaagtt

SEQ ID NO: 14390 - DNA, 25882 bp, Human
  misc_feature (1)...(25882): n = A,T,C or G
tgctggataggcccagagcccagggtccccacctgcctgtagaaggtgagtcctgggttggccttctaggggtccagggagggagtaaaaatggcctggacagtctctgaggggctggaaggccctgcatgtggggcccaaagtggcactggcttatgcatcacgtgcaggttaagtgcatccggctcacctagcacctcttcctgctaggagacaaatctgccgagggcccagccctctgtcactccactaccttctcactgacattgcccactgcaagtcctcagacttgaccaaagaatatagcccatccaggcgctgaggatatatcttctgaccctcaagggtctggtttgagaaatagacaaaaacaaacaaacaaaaaaaaaaaacaacaaaacaaaaaactgagattttcctctgtacaaatatatagtggcagactacactgcagacttaaggaacagccccctatgagcacagttgtgtacccatttgagatacactgatttagaccaactcaacctttatgaggcccaaagccagctaagctttctctccttttccttccatcgagatcagcagatcagcttcagtcaggtgccttgtggcagagcgtggatcccacatggggtccttagaatactacttccctatggctcccaggcacctcgttggtgtctgtatctctctctgtgtctgtgtgtgtgcatatctgggggtgtctgcagatgtctgatgtgtatcctgggggtgtgtgtgtgcatgcatgtctgtgtgtctgtctgtccatgcacacatacacttgcccaggagactaagggatgctgaccaggagaaggcagccaccaagctggaggtgaagtcaggtggacaggagctgggacatctaaaccctagatctggcccctgtcccatgtccatagtaaccccctcacccactctccttctcaagtggatcaggggctatttacaacactcctcccctgtctctctgggtatatgtatgtgcagtttcctcttgctgaaatgcccttcatttcctctctcctcctggaaaatgcctgtctatccttgtgtgagggttcagaggctcagaaaccccttctctgggagggactctcctatctgccaccccttaaccagctcccactgtgcctcttccctcatctggcacattaaattattacttgcaaaataggcacagtggttcatgcctgtagtctcagaactttgggaggccaaggtgggagaactgcttgagggtcagaagttcaagaccaccctgggcaatgtagtgagacccccatctctacaaaaaaaaaaaaaaaaaaaaaaacttagccaggcatggtgatgcgtgcctgcagtcccagctacctgaggcaggaggatcgcttgagtccaggagtttgaagctgcagtgagttatgattgcaccactgcacctcagtctgggtgacagagaccctgatgcaatcaatcaatcgattataaatcaatcaataataaataaataattgcttactcaattaccgggtgcccccaaaccataagctgttgaggacaaggagtgatctgatttgacattgcttctgcacacagaagagggccaggcatgtagcagatgctcaataaatgcatgctgaaaacatggatggagaatgatggggcatgatgaggaagaggcagaaaatgggaaggaagtataggatcaagatgggggcatcctaaggaggggtaagagactaattggtttgtatgggaaagactgggcagtggggaagacaatggggagaacggggttgagggggtggagaagaaggtgggagacagtgcccacctggggaggccaggtcccactctgcctctggagtctctgcagttcctcctctttaaatttcagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaccaggagcgctgatacctggggaagggagactggctctggtcgtgtgattccgggtttagggctctgggccattccccctcagccagctggtgacagagactggcccaccgcctgctgagagggccatctcacctacagtgagaacagagcccccaccccagcctggcttggacactctgaggatgggcccaagcagccacctaccaggactcttggcccggggccacacccagtgctgctagcagccccaccttctcctgaagtagccaggtgtgctctgcctccagggcctgcaatggccccccaacaccatctgctctccctgcagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaaattttgtaattttttgggaggggaccccattttgaattagcttctgttggttacttcggatacccatggtggacctggcaaaaaatttagggatacttaacacccctaccaatacgccttgaaaccccccgtttaaggaaaaccgctggcgaaggaattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccgggggtgagtcggcggggcaggcgcgctggtgccattcggtctcggcctactccctttctttctcctcttcggcccatatcgggccgcgacctctcacccctgacccgctgcttctgccccggagggcggtcactgcagaccctgacctcgaccccacggtgttgaaggcggagcctgaacggcctctggggccgctcaagggtccagtttgggctctgtgcctgcccgcggaatggggtcggggtccgacgtagaagagccagagaagcccttcagacccctcccctacccctggcttcaggcttagtccgcagatgactcctcccttggcggcctggagtttgattctggcccagtccggctttccctctgtccccgggtctcccctcggcgccactggtggcggttacaggggatgggactctgagaccccctgggacctggggcggcaggaagggacgcgaacgagggcgcaggctcccctgtgtgttttgttgtggtggtagagccactccagcccggaggatgggctaggccaagctgacagttcaaatcccctggctgctcctccgtcccgcccgggagtctctagctttagttccgggtgtgggtgccctgatgtggagctggggtggaaattgcctgaaccaggcccccatcagaggcggagttggcggccttccagcttcccttcttgatgcccttgaaaaggaggagcgtttcaccgttggtggtggaggcttgcgaggtggcaggtttgaggttgcagtggtagggcagtccagccaaaaataaccatgggtgctggggtggctggaatccgggagggcagccgctgacctggctggctgcacttctagtcagcccagttctctggccaggaacagcaaatgagaagccgacaaggcctgtgctcaaagttgacatccttggcttggttttcttcatatcacctttttcctcattgtgcagagcagagcttcccaaagcataattgtggcctttagctgctttttaaacaagctgtttgctgaggttttcgagaatcagagataattgagaaatgggccctagagccctggctgggaggatgatatctgctatttccaatattttacttgcctagaatgtgttaaaggaaggatactcttctctgttattgctttgtgtgtggtaccttataactctcatgcttgtcatctcttttgccaggctgagagatgttatctccattttccaggcatgctaaccaaggcctagagtgacttgtctaaggtcatgaggctggtatgtgacagcactaggatttagtttagttttctgccagagctcttgcctcccagtttccttggaagggacttataaaatgtctgtaaggcatttaacacagccctgaagtgttacctggaactttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgtacagccctttgcctggcctttggctttacagagcattcacttcacgggaccgcccccccgggcgggagggaatagagtgcaggaggctcccctttctcctgcctttgatctccctgtggtagtgttcaccgtccccacccagggttactgcctcagcccctggccctggctcacccagttccctgagcacccaggccaccaggctagtgatgctctgctgggagctgtttgtttgttcactggcagagaaagttgtttcctattgtctgctgtttgaccagtgtgacctcagagttcttcttcacttcataaacctctgggaggggccgccttcaaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaaggtgagagggaactagataggagggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggaccggaggatttgcctgtcagccagctcagactgggaacttcccttctgatctccagccaggccctctccagccgagcctctttacgaggggcagtcgcggtgaggaggggcaggtgcctgtgtgatggggcatgtgaagaaatggcagaaaggctgccgccccaggcctcgtccagttgcaggccacatgcccagagcagggcctggccagtattcctagcatggagggttgtaaggtctctggagcccacattgcgctcagtcccctggggaagcaaagccagttgtgtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttattctaagagcagtgcaactctgacaggggctgccttggaagtgatgagctccctgtgctgaggactggaatgccacggagggaccctgttttaggaggaggccggagtgcatggcctttcccctgaggtcccttcctgccctgagaatctgggaaaataggtagggagaaaaaagcaggggattctctagaaggtccctttatcctgggcctgtgagccttaggcaccacagtcagcctccctgaggcctcagaggacacgcccttccaggctaggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtaggtgcggctggagaggggtgtggtaaagggagtggccctgggcctcacagtgagaggtacccttgctggtacccctacctcttgccagatctttactcgatcctggaacccccatccctgtttgctcagacttgcagacaagctcaggaaggtcaagaggcgccgcaggagggttctcggtgggacagcctggccagggttggggctgcctggcctataggttaggtcactgtgtgagctcttggactggcactggttaagcaggattggcctctactctcccacactcctttgggagctggcagtggctgagaacataaaagcctaaggatggcaaggatgctaagagcattaactcacagatctcagggagcttgctgttgggtgggcaaaggtctggtgttgcatggggcaggctgggcatccagtatctgctctcttcagtgccggctgctcctggagtggtgtttgttgggagttgctgggttggggtggagggttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttgtgagtatctgcaaggagtgggagggaagccttcagtggggctgctggacccccaggggcttagtagtgtgccttcacccatccgcactgtgccttctccccacactcagaaccaggggagtgtggcaaaggtcttgctggaagcctttagactgcagtccagtcttcaccccagctgtctctgtgtcctgaggaaggcctcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcctgcccacatggagaccctcggtctaaccctgacttgtcatctccctgccagcctggaaaagcattatttggcagtgccagggctcagcgcagtaggatttgcaatggttgcagcagtacagaaaggctccttggtgaagttggtaggcgttgagctagaatcgctcaaggtcaccccgcatcgctcccctaccctgagcactgctactgtgataggctgcaggccactggggtgggaagccccacatggatgagaagacaggtgtcttcctcctcccacaggatctgcaagatgggacagggacaaggattccaagcaaggggaacagcttggtgaggcctggagcctgttaacgggctgagaattggctccagtggagtagactgccactggggagtggtgggccacatagttgtgagggtcttgagtgccagatgggatccttgagctgaaaagtgactactagcaagaagccactgtcagaaggggctggaggggaaaggcttgcctgcttatgactagcaatgagaggcggggctgtcttcctgggtatgcgacctgtgcactcagtcgcacaggaccctgtgcttgatttaatgtccttttgccaccaccttaatattcttagtaacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggacctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaagtcagtgaagaacaccagcatccgagtggctgactttggcagtgccacatttgaccatgagcaccacaccaccattgtggccacccgtcactatcgcccgcctgaggtgatccttggtgagtgactgtatggcctgtgaccttgtcatactggactgttgttgggagggtatgagcagaggcagtggcatgcctgtcattctctgccacccagggcaggcagagtttctcagaccaaggggccagtgtcatgagacacaggtgactgacctggctttatctgtcagccttactgagagagggcctcgtactgggatttgggcaagagtcctgccagccggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccgagagcacctggtgatgatggagaagatcctagggcccatcccatcacacatgatccaccgtaccaggtaaggaccccagtagccccctcagggttggtatagaggcctttctcttcttggctgtgggtcagcagggtactggatgtggtgagtctttgctggacagtccatggttccgcaggctcctaaaagccttccctgtgtgcccctgcagacctgttgccctggttctgctgctgtcttgggagctgctcttccccacctcccaccagaggcttgtccccttactactcccacacttgactccacccccttaattttcaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttcagcttgtggagagctaagtgtgaactgggccaggcacagaagagctaggcaggggtaagaccagaattggggacatcctctgggcccaggctgctgagcagtcctagatggcacctctgccctgctggcttctgtacctctcagccccagagaacctaagggaatcagcccaccgtggctagccaggtggggtctggttttccacagcctgccagtcccattactggccaggactttaggctgtatgtgcccaacaactatggcctgctgagggcaggagacgagtggggcgggttcctaggctgggacagacagcacctcatgacagcctacagagcaagtcacacggcacaggactcagtcagtcattcagctttatttcagtgctggtttttggttccctaagagctgcatgagtgctaggcttcaccacgtgactgggggccccttgggaactgggtactatgggcaggatgcccctgaaaagaactgaagacagaggaatcatacttctctttaatacctctggggaaggcccaggctaaggatgagggcagggaccagtcccagtgccccctggggagagaagagggagaagcttgggcacaaactcccagtggccctgcaaggctatcatccctggatcttgctggagtggacagtcttctgggccagggttgttctagcttgtttctcactgtacctaatcagggggcctaactgcattaacaggcagccagaacctacctaccaaaaagcctgtaacctagactgctcctcagattttggccaagagagggccccggcttgggagctgcttggccctgagagtgagcagaggctcagagaatacacagcacaagggttacagtccctggcctcttcccatcgctggagacaatttaagactgaagggaagatgagaggaggggccagccctctaccctggctcatctgcttctggctatgttcctacaagggaagtgataacagcctgaaacccgtggtaccagggcctaccctatgtccacaatccttggtgagcccttctgtccacccatccacccgctcagccagcctgggcagacacagagcagaagcagcctgaagccctgaagcaggcttaaacacaagtccttgacaggaatccctgccaggattccaggcatagatcctgttctaccagcctccagggcctagagcttggcaccttaggatttgagcatcagtgtgttcctatggttggaacccacaccagctagctcatccagaactagcctcattttgccatctttgagacagggtgctggccccaagcctactcatctagactggacaaatgtaaaaggttcaaagcccagatgatgtaagagctggggtggagctcaagcacgggagcccatctgcctgctctgggatgacagctgcaaaggaccgtttcaggggaagggcagaggggatgaaagagtaggtggggcatgtatgtgcgggcaaagggctggaggagtggtggcctaggacagaagcaccaggaagcctcttctggttcagcaccaggctcccccagggatatccccatctgaggggtctggccccagactaggcaaaggctcaacctgctcagctttgagggtgggggcgggcactgctggcaagatgggcactgtggttctacagtaatataaccttatactacctgtgctgaagacgacagaacaacataaaatcccaatacagtaacaccatcctaatgccgcccccttccctacctctgagtgatggagggaaaaggagggagagatccttggaaaaatcagcataaaacttggatcagctcaggagtaagggtcaaaaccccccaaatcaacttgtggggctaggggaaggcctggtctgtcacagccctggacatgaatg

SEQ ID NO: 14391 - DNA, 25882 bp, Human; identical to SEQ ID NO: 14390
  misc_feature (1)...(25882): n = A,T,C or G

SEQ ID NO: 14392 - DNA, 7144 bp, Human
ctgggcccaaaggccctatctgtaagttgatgaggagatgaagtgggtgagctctaaaatgcttccttctgatgaccacccaacttgtccatcatgccatgaagggggcgcttacagagtgtcttccctgtgctggagatcaatagcacctgggaagttaaggcctctgccctcagtgggcttcctctctagtaaggggtcgcacattaagcacgcatgaataaataatcacagcttataggaggagctatgaagaaaagtcaggaatgtctgagagaacagtcactgggaactgagggctgaggaggtgcttgtactctgaccctgatgtgcttgcaaggagggaggtggggtgggaactatgagctcctcagagcaccctggaggtaaagctggtggcacagactttgtgcaggtgagggtgtgtgtatgggctgtgcagaacatagtgaagccccctccaccaggaagccctccctgactgacactgaggtcactgagtctcccctctggtttactgaaccctggatgtgtttcttgcagcctctggttggcccaccaaattcaggactttcctagaaattctccagcacagtcaggatgatgcaagagagggcttcctctgcaggggaaagagagggggctctccattggaccataataatatcctcagcatcagactcgggtgttttgcaggcagcatgctggggacttctgtggccttgcttggtgacagggaatggggtgtgatgagctggggcaggcttcctggggatgctttcagccaaagatgagccctgtctgcccttggccctgctgagagggtaagttgagtcatgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggctgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacctagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttaaagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttg

SEQ ID NO: 14393 - DNA, 27383 bp, Human
  misc_feature (1)...(27383): n = A,T,C or G
tggcctcccaaagtgcgggattacaggcatgagccaccacgccccacctatttttttcttaaactgttagaaatgaagtctgggtgttcccacattccttagcaatccaggtgtcttccttcccgttaattcctacataaccacaggccctcgaaactacaggatgcccttttcctccatcaagttccttcttccagtgcttctgagaggccccaaggaacactttcgtgttccacagacctgttggggctgcgtcttgtcctctcggccagccacttgggaccaaagcctgctcttctccctaagcgtcccttgtaacctgtttttctcgctgtagcttccccacactgccttgtcatcaaagtcatcaaaaaccctctatccatcatggttcattcagtagcacagaaacctctccagtctttcagaccaagggactttaatgtaaaggagctcgtcacccagaggatgaaggagctgggacactaatcaggacagacagttcagagatttccccaaagcaggaagctgtgccatcccaccaactgaaaggaaagatgaggggagaaggtgttgccagagccaggagctggcctccaaacaggaacaagaaagacataaggggttgcctggctgatggactgtccagagggagccagaactgcagaggcatatggccattgctggggaagccactcaaacagaaaacgaggggagaaatgctctgatctctgcctccccagtcttcccccaggggctaaacctatcagaaagcagttgataaaggagtctagaaaatgtagtttcctgcagtttcaggaaatgactggcatgggccctaccttaattcctccaaagcacagcttagatttggctgttttgtcaaacaaactttagcaatcagggctgataacaattacaattcaggaaagaaaaacttaaacaccgatctcagcatatcacagcccattacacccaacccgttggcaggatccctgctaaaatttcgcttgcctttgtgtgcttggggccaggcaaactctccccaggggcaggaccctcccaatcgtgtccaccctgaccagagtccaggccccagggcccttctaccttctccaggccctgcaggaaggagaaaaccatttcctaaacacctgtcccttcattcacacgaagctcatgtgcagatcctgccctacgtggcaaaatgatgggagagcagcctgaatcttcatcgtcccgaaccaaagccccattcatgaagttcagccccatctctagcacagcagaaagaatcactgaagtttgagttccattttttttctaaacttttgcagatcctagacccaaaggctcaaggtaagagcggctgggcttcctcacccccaacggcctctctaggggagagctgttcccaagcccaccccaagcgtggggacctgccttgatatggaggatcaaggaggagcatcgggtgccctcaatctcctcctgccagaaaagcaaaggagtcacagcttttcctttgctgcaagaaacattctgggaccttttttttccccctctgttgtccagttattttcatcagggtaaatcccctaggaatagaattattaaagcaaaagatatgtatgtggtgtaggcttttgatccacagtgccaaattgctttttgataaggctgcatatcgtggattattcttgccttttctgcccctcagctccttgataaaccacttgggatgaatcagccaccggaccagataaacaagccagcctgttgctattgctgttttctgcaagtcggaagggaactcccttagatcccgcccagaacctggaattccagagcacacagggccaggacacctttgtacccctgctccccaccggcacaggtcccacccacccccttctccccgccccatgcccgggtggagccagctgccagggcgccaagactcccagccctctctctgtgcacggcagagtagaggccaagggagggctctgtgccagccccgatgaggacgctgctgaccatcttgactgtgggatccctggctggtgagtgcccatctaccctgtggtcagacctcccttatcccaggggccaacgatcagggtcatctccccagcaccctccccagcccgagcatagccagtttcagtttctcccctgctagggctgagcagggtgccgggtgttcacggagaagcaaatgcccagcttagtttgctgggggcatgagagggtgcctcagaccctgggttcttccagggacccaaaggaccctcgggtcttgagggatatagccagctgtctgaactgggggtgctggatcgctgcacctcagtgaatggagaattggcctggaggaggcagacatccttcggtccctcaaacggtgtcggcacagtttgtaccatccttcctctgcctctcacttggcactggcctgacaggggaggaggaggaaggaccgggggaaacgaagcttgagttcactattgcctccctccatgcccctgcagggcctctttggccccttttgttatcatagatctgaaagagcattttctcctagagtggccaggtctgctacattaataggtcttaagacacaggactcatttggaaacaggtcttaagggcatagtgttcaaagccaataaagtgagcggagtggggggctcatcattatggagaacgttacatgagaccctagactctctctctgctctcctggtgcattgcatgaaattcagggaacttccttaggaagtcaaagcatagtcctgattgaggatggcgagcaggtatggcctcggccaggccctccttgctcaagtgcaggacgaggcccacgaaaaggcagagcttcccaccttctctgccactgtcccgccagggctgcctgcgtccccagagcttccagctctgtgggaccccctccagtctgcttcccagcatcaagctgggcgttccaggaagatgtgaggcacccccttgaggcaccaagacacgtccctttagaccctcagccatactggttagaaatcctagaggctcccagccctttgagatgggggaccccaagaaatagcccttaggagattgtcaagggtcagctgtctcgcgctgcacacaccgggccctcacccccccaatcttaggctgactccagagcatgtggaattgtttcttgtttgtgtatttttccttagcttcccagctggttgacagaacattgtttttccacatgaatgtgaaaaaacaagttgccttttataaatccgccaggctgccaggctccacacaacacatgtctccccagatttcacaatatagactttcacccgggaagtgccgaagcaacacaggctgaggaatggatgatagatttgaggaggaaaaggagcgaggagggtgggagaagagggggagatcttgttagaccctgacatccctaaaagacaggagtgggcctaggttcacttaccccacttcaggaagctaactgcagttccctcctgaaaagtggtgccaacctccacgtagcccagggtcctttgccttggcaacatgcccccacctcagccaccagcctccttgcaacccagatgggccctctatttcccacccagaacactgacctcaaccagcaaccgttcccgctgcagactctaccccaagccttgatggagcctggcttctcaaagcccaccctcacccttctgccctgacccaccacccaaccagaagccactgttcaggtctgaccttgactggactcctttcctcaactttagactcagccctgaatccaggacccctccctccagaactgaccccaattccacccagcctcacatccaaacaagatgtcagctacatcctaaggctccacggcacagccgtcaccttgcgtagaggcagtagacccctccccgcgccatccctaaggccccattctggggactccaggaagcctgaagacattttgcagctgctgggccagaacccaaattcagagaggagggcagccttcgaggttggccagaggatgtgcagcggggtcggaccattcttccgtccccatcggtcctcgccaagcctgaggacccctcttgtgtgtagagttggagtaggggaatcaataactgtctgctccctcacaccttgggcccactggcagtcgtagtcgtgtctggggaaggagaggcacagacatattcaagacacacacccaggccgcaaggccttgacccagctggggttgcttaacattttcccacctgtttatttcccacgccagccggccagggcctctgagctctgagccagctgccagcttgggccgccattttcccgcaggctcttgctctccacagcccaagcctgggggcctgagggaagggttttataagttaaggactctttgtttacagtgcagattgctttagaggctgcagcccctccccagccccttccttgaggctcaggccctcactgcccttcccttaacagaagcagaagtgggctggacaaagacctagcctggaagagagggctgtggactcttcaatggccagcttctcttctcctctctcttctcctcctccctaaattcatccctttatcaggtgctcaggtccctgaagccccccaccctcatataaaagggtgaacaagatagccccctccctacagagcgaatgtcttcccttcccaggtctcctcccttcagactcaacacatgtacataggggcctgttagacactaaacacattcacagacgccaacccgctctatccgccccacaaccagtctagcactgggatgaatattgtaggttcttcacatgctaactgtgatgctgggcggcagctctctctgagcctcagctcattcatcaaatggggatagtgatagtgggcacgttgtcgtgaggatttaatgaagggagggacttgcctgaaagaggctgtgcacttcacaaatgccagtggctgctgttgtcattgttgtttgtctttcggtaaatcaaactatatccattttagagatgaggcaattgaagttctcgttgcttaaacaactttcccaaggccaccctgcccacgtgtgggctcagtcaagagcgcctcctccaccattgcttcatctgatcaacttggggcaagtcacttcttacacactttagttacatatctctaaaataagggtgaggacaccaacttcaggttgtgttaaaaagtgaatgagagacaataccaagcatcaatggcgatgtggagaaactgaacccctcaaacaatgctggtgggaatttgagatggtgcagccataacatcctggacaatatatgagaccccatcactacaaaaaatttaaaaataaattagacggatgtggtggtacatgtctgtagtcccagctacacaggaggctgaggtgcgaggattgcttaagcccaggaagtcgaggctgcagtgagccatgatcacgccactgcactccagcctgggggacagagcaagaccctgtctcaaagaccaaaaaaatggtgtggccactttagaaaatagttcgacagttcttcaaaaggttaaagatagagctactatataacctaccaaattccactcttagatatatacccaagacaactgaaaacatatgtccacttataaaattgaacacggtgttcacagcagcattattcatggtagccaaaaagtagaaacaacccaaatgtcctgatgagtggataaacaaaatgtggtatatcacacaatggaatattattcagccctaaaaaggaagtactaatccatgctaccacacgtgtgaaccttgaaaacattatgctaagtgaaagaagccagccaagctctatttacataaaaagtctagagtagggacattcacagacacaggaagtagattcgtggttgtcagggtttaggggaggagaagaatgggtggagtgactgctaatgggcatgcagtttctttttggggtgctaaaaatgttctggaattagataatagcgatgattgcacaacgttgtgaaaatgctaagaaaccattgaactgaacactgtaaggtggtgacatttatggaatgtgaatcacaacccattgcaaagcaaaatggctgagaatggatggttggttagaacagcgtggggagcatcccctcttgctggtccatttgtagaaggctgggggccagggtctccctgcccacccaccaggctggcatcttgaaagcaaagacactttgcatgaaatttatatggggcaggactctgactgagcccatacatgggcagggtgaccctgggaaagcccctgctcaccctcctcccaccctcctgcagctcacgcccctgaggacccctcggatctgctccagcacgtgaaattccagtccagcaactttgaaaacatcctgacgtgggacagcgggccagagggcaccccagacacggtctacagcatcgagtataagacgtaggcttctctcttgaccccacctcctttgactgatctgaagccagcccctctccaaggaattcccctcctctccatatgttcccatgtccccaccaggactggtgtcacatagcccctcccagataaagctttgctcctttatgtttcttttgcagagggagaataatataagggtaaaaagtacaggtgatagggtcaggctgtctgggcttaaatgccgctctcgcctgtataaccttgggcaggtaacctcacgaagcctcagtttctccacccacaaagtgaggacaatgatagcactttcatcacagggttgttgggtgggttaaacaagataaagtcattagcacttgtgcctggaaatttataagctaccaataattgttttattattattagtgagactaggtcaaccgaagatgcacccagcccctctagcccacgctcctgttcctgctcctctccctcccatgcaggtgaggaggggtggcctgggctcaggagtcctcaaacctggcttccactcctggtcatgccacgttgtcctgtagcaagtcacttccccctctctgagcctcatttctctcatctgtaaaatggggataacagggcccacatcaaaggactatggtgatgacgagcccagaatgtggactcagactggctgggttcaaatcctggctctccacatgcacacttcaaacacgtgggcaatttacttctttgagcctcatcttctttgtttgaaaaataaacagaataggctgggcacagtggctcacacctataatctcagcactttcagaggctgaggcaggtggatcacttgaggttaggagttcgagaccagcctgaccaacagggtggccatactgtctctactaaaatacaaaaattagccaggcatggtggtgcactcctgtaatcccagctactcgggaggctgaggcaggagaatcactcgaaccccagaggtagaagttgcagtgagccaagactgcaccactgcactccagcctgagtgacagagcgaggctgtgtctcaagaaaaaaaaaaaaaaagaaaggaaggaataaagaaagaaaaagagaagaatgcatatgcctcagagaatcattgtgagaacaaaatgagatcattcgcataaagggcctgggccactgaacgtgctaagtaaatatcagatctccttggcattattaataagccacaggcctagcgctggccttttcatcaccacggtgacttggccccttcctgacctgcaggtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacagtgagttggagcccctgtgggtttcaggggagggaagaggaaagcgcaggtgtttgcggggtgggatggcctcttcccctctggagtgggtggagggtccagaaggggctctctgcaaggggaggggcagctggggatgtggcttttagggaagccccccacccccaccaattacagtgtgttcctagcaggtttgttcacttttctccacctccaccccaacctccctagttcagaccacccttatcttgacccccgactgcagtcaaggccacctaacttgtttccccaactctcctctttaccacctcctccagcccattctccacagagcatttagagagatctcctcaacacataaatcccaccttctcttctcagcttaaaaccctcgggcagcttctcatgactctacaaataagatccaactccttgccacggcccacgaggccctgcctatcctggtcctcatcttgaacatgtcttcccaatgcatcgagcagccaagcttctgacagtccctgcctcgggttccttgctgctcccactctctgggggcacttctgagctcttcacatgactggttcttttatagtcctcacggctcagcttcaacatcctaagtcagtgtccccacctccagccctgatgacctgatttctgtaggccaccatctgtgattctctagtgcaatacagggcttattgtcttcatcgctcagatcacacgctgcaattactgtgtttgctcacacatgttatcatctgcctccccctctaaaatgtgagctctagaactgtatgtgtgggcggcagaatccactgcattcccagccctcagcatagtgcctggcacatagaagattctcaatagccaggcgtggtggctcacacttgtaatcccagcactttaggaggctgaggcaagagcatcacttgagcctaggagttcaagaccagcctggggaacacagtgagaccccatctctacaaaaaatttaaaaattagctgggtgtggtggcacacacttgtagtcccagctactcaggaggttgaagtgggagggtagcttgaacccaggaggtcaagactgcagtgagctgggattgccccactgcactccaacttaggtgacacagtgagatcctatctcaaaaaaataaaaaagatattcagtaaatgaatggttgagtggacagcagttgctgatatggtttggccatgtccccacccaaatctcatcttgaattgtagttcccataatcctgtcttgtgggaaggacccagtaggaggtaactgaatgatggggacggttccccccatgctattctcatgatagtgggtacgttcttgtgagatctgatggttttataaggggcttccccctttgcttggttctcattttccttcctgccaccatgtgaggaagaacatgtttgcctcccattttgtaagtttcctgattgtaagtttcctgaggcctccccagccatgtggaactgtgagtcagttaaacctctttcctttataaattacccagtctgaggtgtgtctttattagcagtgtgagaatggactaatatagttgccaaactccccacacaagctaagcgtgtgacgatgttcaccaactgactttatagtcacacatagctttttaagaaaataaaaaataaaattaagtaaaatattgtttttttaacctggcttgttcagtgaattcacattcattgtagaaaatgtgtgaaatatagaaatatacaaagaaaaataaaagtcacccaaaatgatcttaacattgtaacataactgcagatactagcagccgtatctactttgcaatctggcattgcttttttgtcttaggttctttttctccatatattggtatcatgaacatttacccatatcattaaacattttgcacaacaagatatttcacagtgcaaaataatccattctagggagatactctaatttacttatgtatttccctttttgaggacatacagctcagtttttcaattttattagcagcactgaagtaaacattgttctgactcagatatcttcaatcttggaggccaaaggatcattgaggaatttttacaaattagattcagggtaaatgaggtccatgaatccctgaagttggatgcaagatttttgtatatatacattttggcaggaagaagacccacagcattcatcacattctcaaaggagtctgtaaaccagcaaaggtaatttggttatttggaaaattccatcttgagagagacagaagtcttcagcctgatctttgaggctgcatcaatagtattaggccccaaacattatttaggatgtgtagttgatgtcattgacatccccaaagctgtcatactcaatagatgagggaggaagggtgctctaggctgacttaaggtggggacgcagggggctgggatgtgtgggggcaagccaaaggcatgaccaagctaggggactggtgcccctccccctgagttcttctcatccactcttggtcatccctttgccagcctgaaacccaaacaccagggcttgtagaaacttttctcttttcactgtttgtttagccgttgctttcagaagcatagctggcactggagtggaaggagagagggagcagtcattttccactgtccaaggttgcctcagacactacccaccgattctgactttttcttttctcttttctctctccctatccccagctaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatggtgagtgtatgttgcaccctggtctttctctgcctaggaagcctcttccctcccaattagatctgagttgctttaagaaaaaaaggggacatgttatgtaaattagcatttcccaaaacatgtcccttgagaggctccttgaagcctggaaatcatcacaaatgacaacttttctcttgtagattcacacacacaatagcatgctaaaagctctgacaagtcctgcagagccaagactccactatcaatttgttttgttgttttgttttgttttttatttatttatttttattttattattattatactttaagttttagggtaaatgtgcaggttagctacatatgtatacatgtgccatgctggtgtgctgcacccattaactcgtcatttagcattaggtatattatcaatttgtttaatacaatttctccagaatttatttgaccagagaagctgctttttttgcataatatttacattgttttttgtttaacaccttctcacatcctggggaacaacctctattaatatcttcagatgttcacattagaaaatgctagaatcaatttctactgctgcagtagttttccaatatttgcaggaactatatacaggcaatgtggaaggatgagtaataataagaggtggaaggcaagggcatacattctcaaatagtacatgaattatttcttttcgtattcagaaaatatttggtaccccctaccctcagcatgtgccaccaatccacaattcagttaaatgaatatttatttcctactttgtggtttctgcatgcaaggagcttataatctagggggtgaaaaggaagttaaaacaagaattcaaatagctataggtagaggaaaatatgggtattgggaggtggggcaggatgtcagcacagcaagatttgaaagacttccagaaaacttttaggaagccaaaaatgacataatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacacggtgaaaccctgtccctattaaaaaatacaaaaaattagccgggcatggtagtgggcgcctgtagtctcagctactcaggaggctgaggtagaagaatggcgtgaacccgggaggtggagcttgcagtgggccaagatcgcgccactgcactccagcctgggcgacagagcaagactccatctcaaaaaaaaaaaaaaaacacacacacaaaaaccatggtcccaaacaaacagcatcagaatctcctgcagcacttgtttaaaatgcagattcttgggtccccttccagtcaacttcatcaagttattgcacttgcatccctgggatctgaattttagtgagcaacccaggcgcttcttccccaacgcaaagcttgagaacctctgacgtggagggaccccgggagataaacctcagaagactggatgggactatgctgtagaagggatagggtggtggaggggacgaatttttgtttctttcggtagttgggggagccactagagattactaagcagggagagtccttatcacaactattttttggtaaatatttagggtcttattaaatattttattgttgatttctaatttaattcaatttgtggtcagagaacacacgctgtatgatttcagtccttttaaatttatcgaggcttgtgttatagcccagcctatggcctgtcctggtgaacgttccttgtgcacctgaaaagaatgtatattttgcagttggttggtggagtgcgctataaatatcaattaggtaaaggtgattaattgtgttattcagatcttctatgtctttcctgatttaggtgagaggtcaattggtcgtttaattgttgaaaatagtaaactctccaactataattgtggatttgtctattttccctttaattctgtgcatttttgcttcgtgcattttgaaactcagttattaaatacatatatatttatgattgttgtatcttcctgatagattgaaccttctgtcataggaattgttcctttttatttgtagtcatactctttgtattgaagtctactttatcgatattaatatagacactccagccttcttatggtttgcataatatatgtttttacattcattttcaatctgcctctgttattatatttaaaatgtatctcttgcagacagctctgacagcctttacctttttttgacattaattcacatgccataaaattcattcttttaaagcatacaattcaggtgttacttgcctattcacaaagttgtgaaaccatcaccactatctaattctcccttatcaatctttcttcaagttctctattttttctgtcatttccaaaatgtttttgagataattcagtgggtttttaaatttcagataataatatctagaatttttcaactctaaagttcctagattttatagtttccatattctactgagattttctattcattcattcaatatgagcttattttgtttcacttcctggagcattgttataccgctgctttaaaatcattgttggccaggtgaggtggcccacgcctgtaatcccagcactttgggaggccaaagtgggtggatcacttgaggtcaggagttcaagaccatcctggccagtgtggtaaaaccccatctctactaaaaatacaaaaatcagctgggcatggtggcaggtgcctgtaatcccagctactcaggaggctgaggcaggagaatcatttgaacctgggaggcggaggttgcagtgagctgagattgcaccactgcactccaacctgggtgacagagtaagactgtgtctcaaataaaataaaatcattgtctgctaattcaacattttggtcatcagggtcagtcactattatcttttctcttgaatatgggtcgcatattctttctttgtatgtctaacaattttgaaatgtatcctggacattgtgttgaaattactgtagattctgttatattcctccaaagagtgttggtttggtttcatccggttttggtaggcaattaatttggctgaactccaaactctgaaatctctcttctttttttgttggttaactttacctgggctgcttggagtctaccccattcatgcctactttaggggccggtcagggatttgagcagagtttatatacagagtttgggcctccttctctacactctcccctgtctgtgctttctcccctcattttccagctgctgtgattattccaagccctgccttttgggtattcaagccactgagaataaagggtttctgtctaggtttagccattccacagggtgtagactgaggtctgccttcaggctacaagacagtaaaaatgggaaatgtacccatcgacatttctcctctctccaatatatgcctgcttttattttctctccaatgcttttaagtagttggttttcattttgcttagaatttatagttgttattttggggatgtttggtccaatagaagatataaattactaggattagaatgaagaaagatcaaatatggaaatggaagagatatcaggctggcaagtcaaaagattattgcaatggtataggctggaaatgagggcctgaaccaggatggaggtcgtgaaaaacttgggaaaggaggaatcagggccttggcaactctcctggagttatgtctcatgatatgtaatgtgtccagttccaaccacatgagttccacaaaacaataagttaaaaaatttatttatgtacttcttcactcactgtcaccaccatccccataaacacacacaaaagaaaacagtaaattaccctcaaccttggcctccatgtgcctgaaaaagagaaggcagagctgaaatacaaagagccaaagaaaattctcagtttttgaactcccgagaacacaggttctggccctttaaaggaagatttctggatcctttaagggcaatttgataccaaagatatgagaggggatttgtccaaaatggcttcaaggtttaggccctggagattagaagaagagtgatgctattatcaaaattagagaatcaaaagcagatttgggtttggggtctgggatggggccagccccagagagaggagggcagcatgttcggacatgttgacttagagatgctcacatggtactattcagcagggagctggcagggcccatcagaaactctacagctcttcctgagataagtttgggagttatccacacatcggtgctcacagcagccatgggttcagataagatcactaagtggctggagagtatgtgagagagaaggaaatggttgaagagcaaatcttgcagaacaacattgaggggctaaaaccagcgaaagaccagtcagagaggtaggaggagagccagacaggataacatgtggcagccatgggagaggagttctgggtcaaaaaggtgagagatacacagaagaacgagaatcaaaacacagttccagcagaaggattggcagatgcaaagaaacaagggctttcttatgcaaggtaggtgtttacccgagtggcaggtatccagcattgatgagcctgcagagccaggtgggctgcagagacaaatgagtctggactggaagccaggcaccaggactctattctgtaaatatgggtgaggccatcaaagccttttgaatagaagagcattataatgagattgtcttttagaaagattcctataaacactaggatgaatatggaagtgaacaggggcaaacccagagatgggcgaccatgaaagaggctactgctagagtccaggctgaagccttgaggcccaattaaggcagaagcaatgaggaaagaaagaaaggaatgggtgttcaaaaagtttatgatgtttaaccacaaaaaggtgaaggacaagaaggaattggaagaaggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgagcaagcttccttgggctctatgtggagatcggtgtgtaacaggaatcacattccattctctgtccaattcagcaccttggagggaagcagagagaatatgagttcttcggcctgacccctgacacagagttccttggcaccatcatgatttgcgttcccacctgggccaaggagagtgccccctacatgtgccgagtgaagacactgccaggtgagttcggctgaaaccagagggaggtggggctcccgaattcaagtcttgactcttctctttcctccctgtaaccaaggtgagacttggcaacactctagaaaaccatggaagggttatcagtgtgttattgaagtcaatctttgtttatccataaaagagttggctgatgagttatcaaagcaaatgtttgattctcaccctccagcctatgtctggatttcccctctctgacaggccttatgtgtaccttggcaaagcaaactcaccttaatattaacccaggtgagatatactggagggaaaatctgcaggggggaagcagagaagataaaaagatccctcaatatcttccaaagtcaaataataataatggtatcatgataactagcatttctgcagtgctaactgggaaccaggcacaaccaagggcaagcctcatgagcagtctatgaggtaggtattattttcatcctcattttacagatgaagaacctgaggttcagagtggttaggtaacttgcccatggccgggcacagtggctcacacctgtaaaccaaacactttgggaggccaaggcaggaggatcacttgagcccagaagtttaagaccagcctgggaaacagggcaaaaccccatctccacaaaaaaatcaaaaacttagctaggtatggtggcgtgcatctgtggtcccagctacacagaaggctgaggcaagaggatcacttgagcccaggaggttgaagctgcaaagagctatgtttgcaccactgcactccagcctggatgacagagtgagaccttgtctcggaaaaaaaaaaaaaagtgacttgcccaaggtcacacaggtgctgagggatggaatgaggcctaattctagaggccatgctcttaccacagagctactatagatacagttgggttttttgtgggtttttattgttttttgtttttgagacagagtcttactctgtcactcaggctggagtgcagtggcacaatctcggctcactacaacttctgcttcccagtttcaagaaattctcccacctcagcctcccaagtagctgggattacaggtgtgtgccaccatgcctggctaatttttttttttttttttttgtatttttagtagagacggagtttcatcctgttgctcaggctggtcttgatctcctggcctcaagtgatccacccacctcagcctcccaaaatgctgggattacaggcatgagccatcacgcccagcctagatatagttttgaatcatctgctcagtgagatggtcccttcctctagcacactgaaacttgattctcatcacaagcatcatgatgtttttattagtgtttcttttcatagacggagggaaacgttgtattgctcagagctgcaggtttagaggatgaaggtgacggcagtggatgtgatagatttggtaaaacagtctccactttatcctcatgttcagattcatgatgtcagtaagtgatttcagttccaaccatgccaacattcagaatagagttgagtttgcaagctggacattgtgtgtggcatagtggaaagagaagtaccgtgtgaggaatgagaaggcacggtattagtcagatgtcagccaaccacgtgcctgggggagtcactcagcctctgggagcctgatccctcatctgacaaatagggatgctgatgcctgggctgaggtgataatcagaggccaggcagctgccagagctgggccctagaaaatgacactctggtcctcaggtttgttcggaaactcatcacttttccaaacagcccacaagagactgatttctccacctgaatcccagtgcaccaattggcaggggagctatgcctcacggaacagccaacactggccacttgcatggggcatgcccttcctggggcaaaggctgctagggagctcagaatagaacttggcaagaggagaactagaaaaaggaaactgacgttctggggctaagctgggagtgtttgtatgattcatgacccccttccctggactgtcctagataaatctcagctgctcctggcccatgggacctggcccaccagctttttgacaatgtgaagaccactccacccttacccacaacacccttctgttgccttactttgtcttgcttataatgagataccattttttcctaagactatagcttttatataaatcacacttcctggtggctacttcttgctgacgtatagaaggcaccttatccttaaaaatatatttaaaacaattcctacatttattaggttctactatattgccaagcaaatagttgtgccaaatgctttacatatattatttaatctttattattacatgtaacatatattatttaatctttacaacaatcctgtaagctgggtagcatcatcctcgttttacagaggaggaactctggctcagagaggttaagcaacttccctgtgaccgcacagctgcttggggaacctgattgattcatctggttctgaaggctgggctctacccaccactttgcaactttgtttacagtgagccccctgtactgcacacttcttcctcctacttccatttcagagtgatgcatcctgcccttgactgtgtatcctgacgtctgcattaccctcagaatcccctttacctacctctccgtagataaacagggagggtcacagagcattgtcccagcatcttgatgacggaagaggctctaagggccacctcacctcatatcctactcttacagatgaggaaactgaggcttccttgcagagtggcagggaggatgagttttgagttacacatgtaactccactgagtagctgtgtgaccttggtcaggtcacttaacctctctgggactcagctttgttatccataggaagggagcgtccctacccctctgtgatgtgtttgatgatgtagtgagataacataggtagagcacccagctctacatgatcatacagatcatggcctgtagtaggagttcaaccactgctggctactgttattattaaagggtagaccagagagggtcgtgcagcaggaaggatgctcagcatatctgtggcagagccaggcctctaacaccctgtattccttactctcaggctggtggtgtttttatattccatccagcctccctatgggtgaaatggcaatgtatccaatacacacagtgtgaaatggaaatatgtcaagccagagaccattccatgtccctattctgtcctggaacaaacagcagtggttttccaggaatgttatagacattcgggtggggtctttttcctggagtagggatgggggtaacatgtgacaggagacagggtttcactgaagtgggaagctgacccagagaggcccaagctcgtgggctaggggaggatcgaggagtgggctagaagtagaggttccagcagtacccggagttcacagtgatcgccgaggtcattggagctattgataaactctccaagctgaggctgcacaggggccaggaagagagggagggtgattagctggcccctggactgcaggggtcttgactctctgagtcaccttccctctgttgcaaactgtcagttttaccaaaaactccaacaacctcttcctccataagtccttcacaagccccacttggactggtgacaggaagtgtgtcctgcctggaactggctgcacccatcccaaagatgctgagacacagggagaggctcaggcactagagccctagtcatccctctcccctccattttagacaggacagtgccttcccaggctcccttcttgaccaagatcttccctgatgcccagccccttatcttggtagggaggtggagaggacaggcctccctgttttcacttctcccnnnnnnnnnnnnnnnnnnnnnnnnnnnnnnnnnnnnnnnnnnnnnnnnnnnnngggcctttccctgcacccagcactttagaaggcccttctctggccctgtcctggccattcccctccttgcaagatgaagactccatacaacaaagggggcagatccatctggatcctgtgacctcctttctagatcacattgtgagtacctgggaccctgaaactctctgtacatatggcccagagcctgtgatccgtctaggcagtcctcttttgggggtacttcctcatgagggcagacactgctgacatgtagtgcagacccttggcccaaaggatgaccaacaggtggctatttggaggggacatggatgagctcgaccatgagggctggggcatctatacacatgtgcgtgagggccctggcagtgtgggatggaactgggctgggctgggctgggctgggggcctgcagtgcgctgcgggctttccctgtacctccccacttcagcacagtacctagagaagtccaagaactctgaattaaaatatggcatcccaggtggttgtaaaaaatctttttgttaaggtggaaacctcgaacattttatttatttaacagtgtaaaaatataatttgtaaattctgactatttagatgtacagtatatggacttccatttgtgatcttgcattctgacggtaggagaggccttgccagcccagccagagagggttttcagcatccacatgtggggccagacccaaccgggcccaggcagagcccagcctcacgcttccttctctggcccctttggtttcccagaccggacatggacctactccttctccggagccttcctgttctccatgggcttcctcgtcgcagtactctgctacctgagctacagatatgtcaccaagccgcctgcacctcccaactccctggtgagccatccccccagggtgggagggagaggtccaggggagggcctgggctccgaggtccccagttgtccccaaaatgcagggatccacagacaaagcaggagatgggcctgctctctccattcacggagctcacagtcccagctaaagtcaacggacgtgtagcccagcaggtctcaggacacatttgaagtggggtgggtgatcaggaatagtagacatggaataaaaaacccacatggcttggaagtgtccagcaccaggagggtagtgtgggacttgagtgagcagcaaggcaacgagggaggaatggtgggcgccaggagagccgtggcactcatgccctgtctaaatgggcagccgggcaccaccatgtgggaatgcaggcccagcactgcctgatcttcatgtttttcaagagaagccagagtttcagattatattgtggaatctcccaattttcaaatattcagaactaattttttaaacagatttttttttttttgagatggagtctccctctgtcacccaggctggagtgcagtggcatgatctcgtctcagcacaacctccacctcccgagttcaagcgattctcctgcctcatcctcccaagtagctgggattacaggcatgcaccaccaccacacctggctaatttttgtatttttagtagagacgggttttaccatgttggccaggctggtctcaaactcctgacttcaggtgatctacccacctcggcctcccaaagtgctgggattacaagcgtgagccactgcacctggccattttaaacagaaatttttaaatggcaaaactaattgttaagtggaaagccctttgttacagttcttttagaattgctgtagcaagtgaagaccagaaccaccccccacccaaaaaataaaaccaccccccacccaaaaaataaaaataaaatggaaagccctacatcagccacacaaatcacatcagcagcccccacctgacgccagtgccgcctctgctagagcagcaaggccactgcagaagccatgagctgagccacctgaggcacccggagcctgctcttgcccatcggagggacagaggagctctgagggagttttgctcaatgtgcaagtccagatgaagcattttctgtaaagctctcccggtctctcctggctccttcttttcccaccctgaccctgtattaggccctcagggacccgtgggccaagcaacaatgcgggccaccacctcgagatcatgccccaaggcaaccccaaatcctggtcatctactccctggattatccgcctcctggagaaaccagagcccagatctctctccctgagataacccaggctttagaaccaaagagctgagagaccctgtcccttcagagaggcacttgcacctagaggagtctctggggagcagatggggatatgggacagacgcatcttgaaaaagcccccagatgcctccctatggaggacctcacccacccacatcaccagtagggagcttgggacttaccctaaccacaggggggtgactgttgtcgtccctgcacagaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttccggtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccatgccacacactctgcgatctggcctcagacgggtgcccttgagagaagcagagggagtggcatgcagggcccctgccatgggtgcgctcctcaccggaacaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctatttcctgttgtgattttttttttaaactacgttacacaaggagtgaccccctcccccaattcggattggcttcagacacacctggcattttctcatgggcttaaatgacctggatttcctcaggacaggcaaagctagaggggtctggggtgggaaagaggagggactgcagggccttctagagacaagagttcagagacaaatgatgtggaaccttctccctgagatcgtaggcagaagccattgtgggtggcagtggtaatctcagacggcctctgtccatccagcctccctgatcccccacagaggcagtgttgcacactctgtgctctcagactgctgccataccctccgtatcactgcatctcagacgacccctaccatgaggaagccaaagtccagagggagaggggacctacccgagatcccactattgaggctgtgacagagttggagtgcaaacctagggctttttgtcctcatcgagagaggaagctttccacacctgcttggattcttggaggatgagactagtggaggctaaggaggggaggcctcctaatggggtccccaagagaaaagtgctcctggtcaccttgctccaaagtctttttgtttgtttgttttgtttttccttttggagaaagggtctcaccctgtggcctaggctggagtgcagtggcatgaacacagtttactgcagccttgacctcctggactcaagtgatcctcctacttcagcctcccgagtagctgggactacaggtgcatgccaccatgcccagataatttttggtatttttggtagagatggggtttcgccatgttgcccaggctggtcttgaactcatgggctcaagtgattgtcttgcctcagcctcccaagtagttggaattacaggcgtgagccaccacacctgccctccaaagccttttctgaacatttctgagaaagaggatggaacaccagtcacctcagagggacccttcccagagtggacagtgtccttctcttcccaggtacatctcctcttctcttccccacccctcccctttcctgggacacagtgacaggtggtggtgttcttatctgatggtaattaatgtttaacatctcctcggtgtcactggtttagacccaacacctccgtgcagagggatgggtctacctggacagccccccccagcccattcacccctccacggcagccaagtcagccggatgacggctcccctctccccacccactgcaaacaagtctacttcctgttgcttgggtcacacttggccaaaggttaactgtcttcaccttgtttattggtgaaaaacaacctaacaggtggactattctcaccaagtgagacccaggagctacagaagttttttattaagaccaggcgcagtggctcacgcctgtaatcccagcacttttggaggccaaggtgggtggatcacctgaggttgggagttccagaccagtctggccaacatgagaccccctctctactaaaagtacaaaattagctgggcatggtggcaggcgcctgtaatcccagctgcttgggaggctgaggcaggaggatcacttgaacccgggtggcggggtttgcagtgagccaaaatccagccattgcactccagcctgggcaacagagcgagactccatctcaaaaaagaagttttattaaaagccataaatatctcttccaactcacagtaacacgaagctctttgccctcctccgggtgacaaacatttcagaaatgattctgggagggtggagtctgagtgtctgaagagagggatggatggcttcgagtctgtgactcacccctcctcaggttggccctgtctgcactgaggggcggggaccagactgcatgacccctgaggtcccatgcctcccaggcagcccaggcctgcagatagagctggaaccagccagaaggcagagcgtccgcataccctggagctggctggggacctcatcgttcctgagagtcctg

SEQ ID NO: 14394 - DNA, 20520 bp, Human
acacctggctatctttgtaaaatttttgtagagattatgttgcccaggctggggaaggtacatttcttaaccctagggctggctatacaggaatccattttattactttttaaactgtgcatgtatctgacatacactctttcctgtctgcattttttcacattaaaaaatatatattttaaaggggccaggcacggtggctcacacttgtaatcccagcaccttgggaggccgaggcgggtggatcacctgaggtcaggagttcgagaccagccatggccaacatggtgaaaccctgtctccactaaaaatacaaaaattagctgggcataggggcaggcgcctgtaatcccagctacttgggaggctgaggcaggagaattgcttgaacccgggaggcggagattgcagtgagccaagattgtgtcactgcactccagtatgggcgacagagcaagactccatctcaaaaataaataaataaataaaaagtattttaaaggaaggggaggcaggctctggttcccacacaatccccgctcagtgaccctggagccacccctggccacgctctgccagcagagaaccaaagccaggtcccttcagccctaaagaggccataaccacatgtaacccccgtgaaatgtccgcacatggccccgctctggctgagcagggagaggcagcacaaccagaaggttccacaggcatccacaaccctccctggggctttccaagagtatctgagatgcctgtagggtgggagacgtccttcccctaaacagacaaccctgccacagcttcacagaggtgagatttcggaagggagccccaggcagaaaaagggactaaatttgggggcaggagggtcaccgcttttggggaccttcgtagcccccgcaggtgcagccctgggggagagatctgcccatcgcagcctccagaggcagtgaggacgccctgcccaaggggcaagcaacgtaggtgatgggggcagcaaaggggcgcaggaggcctgggccaggcccagtgatcccacccctcaggccctgcccccgggcctcggcctgcacaaatcaggttgattcccgacctccacaatacccagggcactgtgctgcagggacactttcccacaagcccaacccctcacagcagcacaagggaagaggcaagaagacctgagggtggtgggcagagccaggcctccagcacacggaacacagagggactgcaacggtcctctgttcaggtgcctgagagcgggatctcctccgcctcaactggatctcagcttaaaggccagctcattagagaccactgtgacctcccttctgggcggccgtccccaaccctgggccccacccccacggcccccgcctcaccccggggtccccaggccacctcctcctttgcttcatctgcggccagctccccggcgtctgctccgggcccaggtatgagcccgcgcgtcactgcggccgccggggcgccgaggccagtgcggggacacagcaagcctcccgccttcggaccttccgccgtggccccgcgagtgccacaggtttccacagggccggggcacgtggacccgcgcagcctgggagccaggaaccccaaccccggcgaggggcgcctcgcacccccgtcctcacgcagtccccgaggcctcccggtgactgccgggtgtgggaggaggaaggtggcaaccagccccgcagctccagttgctgcaggagccccccgggcctcagtctccaaatacgccaaacgggcgggagtgagccacaggctgtcttcgcggaagactcacaggcgcaggcgcagacgggtgcgcgcccctagggtgcgcgcgagctaagaccgcggcccggggcggggtgtccccggccccgccccctgcagccctaccggagccagcgcgcctgcgtcgcgggcgcacggtgggcggagttcccggcgtctccgccccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggttcgcgaagggcacgtcgacccccgcggcggcggcggcgacagggccgggccgggggcggacgcagacgggccgggctgaggctggggcccggccggagtcggggctgggcggacgggcgggtcggtgagctcctcgcacccctcacaggttcccgaagtcgctcgcggccgcttgtcctcctctgcctgtccctgcccccgcccgtcgcccggaagtccgcttggacgccgggctcttctccaggaaacctgggcttcctgcttccctcgcctctgcctttctcgtttcccgaggccgcccgcgcgtggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagtccaggcagccagttgctgctttgcaggaattgagcagaaatgcactcggaatcgcgggcaggaaaagaagggaggtcggaggctttggatggtccccgaagtcgccgcctagttgagagctgtagagttggtgccactgcccctgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcatttaatttgaattttcaccagcactgcctaggtagccagaaccataaggtcctgaaatgccgtactattagctgggtccaaaattgagaagaattgagtagtgtaaatgttagtcacacatctcattggacacattgttagagtgtgttgtccatgttttcacatgttggtagactggagaatagctgtcacttgtcttcaggcgtatcttgttgaaaataaatccaaatcactgcagcagtaggaatatgctgttgcctgtgaggcagattttcggatttgctagttgaaaaagatttgaaacagttggtttggacaacagctgagtcacacaatgactgtgagtgaaaagcaaaaactggttctgtgcccctcacagttctggttttgtacatcatgtggtctagctatgggctgtacctcttgcacaatatggagaggacattcagacatcttcaactgctcatctgcccctacggaccagacaggcttgaaactataggaagatgcatttgacctttcatttttcagttcagtagaatttaatatggactgtcagccgctgcggtgatcatggaagtagacctaagagaaaaaaacttgtgcaagttcacacgtggagtagtatatgaccatggtttcagagaactgaagcagttctttttagattcttcaaattaaatgtctccttggtgtatttaaacctgctgttactcacaggccaggctccaccaagctttcctacacacttcttcctgagctgtgaccattctcctgagcaagaggctgcagccagcctgggctggcgggcccatactgtctctcataggcattctctccccttgacctttcacctccgtaaattcaagagggtgaaaggaaatagagtgcactgtcaaagataattgggagagaaacacgaaaaggcctcgcagtggggatcttaaattatgagaacttgtgttttctgtgttgtgcctgctcctcattggcgtggatggttggtaggggcattctgcccgtagcgtctgaagtggtcttttggaaaagatttggccccttcatgttgggattccaggacttgccttcatcctcaggttaatattctcctgtgattgttacaagctctctaaggcatagttgcatttattgccttacagctgcgcagctgccgcaccgtccagataggtagtttcacattctcaggtgggtcagatgaccttgttagcgacttgacagacatgtcctggatgctctttgttcccaggaggctctcaggtcctcccccagggtcctgtcactcagccacctacagggatggggagacagtgaggctggctgataagccataaagtccttgactaatcctggtttcctggttctcacacagtggtaacaagggcttgcagccggttgtcagccaacagactgggaagggtggtgcttcttacaggccctgataacaggagaagcctaaatgacaagagaagagacagggaaagcataaaaggcaggcagattttcacaggcacagcaattgaaaatgattctgtttagaaggcagacattctcccacacccttgaggcccagggctcactgctggtgtacagcatgaagtggacaggagagttgattcagtccatgaacatttcaggaagttagaagtctatagttgtggattgcaaaatacatatctggcctgcctcccatttcctggctaaaatacttggaatctccgaagtgatgatgtctttttgtaccctaatgagttgaccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctcaaaaaaaaaaaaaagaaaaaaaagaaacagcatgaaattccttgttgatgggaaatacccgaaaggcctgcctgggttttcagagagcttccagaaagctgaattcatggaggttcctggagaatggcacagccaggagggaaaggtagcgccgtgtctcttccctcatacaccgcccactgcatctctccatctgtatcctttgtaacatcctttatgaaaaaccagtaacctttagtgtttttctgagttctgtgagccactctagcaaattaattgaacccaaggggaaggagttatgggaaccctgatttatagatggctgtccagaagcacaggtaaaataacctggagtttgtgattgcctccaggtagacagtgtcagaattgaactgaattaaacgacacctagctggtgtctgctgcagaacgcagaactggttgcttgcttggcatgtagggagaaacccctgctcatgtggtgtgagaagcgacctgtgttataagagtgtgtgagaaactgagtttgggttttcctatgtcctcaaaatagtatattttgaaagccttctaggcagaatgtattaaaatagtttttactccctgaagggatgccagcaagctagaaagattcatttccaaagggcttccagtggtagcatggctagacatgagacatctttccatttgtgtcatacagcaagttatttttgcagtaccatatacgctatgcgggaaacttttaagtattttataggtttgatttaggtacaaatggccaagaagctatcatctatactcatcctggggattgggaacggaggcagttagatgtgcctgtgctttgtaccttctgtagatgggaatgcagttgctcactcaccaatcaaatttattgatttatatttaaaatactatgaatacatcttctggcaattttggtggtgacattttccttaaaatatttgtactagccaggcactgtggctcacacctgtgtagtgcaatctacttgggaggctgaggcaggagagtggatcacttgaacctaggaggtcaaggttgcagtgagctgtgatcataaccactgcactccagcttgagtaacagagcaggacccttagctcttaaaaaaatttatacctactcatcagctgaggacctgggggcaggtttagaaaacagattttgaacacacatccttccctccctcttgtgtctgacatcactgagctgccacacttttgccttcagtagttaacagcatctacaaccccattttcccacatttttatggtcaaaagaatgttcagactgacccacacatgagtacagtttttaaaaagcatgcaattccttgttgatgcgataggtttttcgtgacgaacttaatttttagggaaagcacatctgcagatgtgtacagttgatcttcatgagccctatgggcctgataaacattcttttgccattgttttctcctctccttggtggtgagtcacttgtgcagtgcccagcggaagagggtgggaggctggggaggaaggcctgttctgggcaaaggaagccctgcttgatgagcatgaggctccacgggggcagtggctgtgacggtgagtgccacacagagctgcccacactggtggagggaaggcagggagataccaggaccatccggaaggggctgagtgtcatttgacaggtgccatgtgagcagagatgtgaaggagtggcccgggacaatcagggcagaatccctgaggtgagtgcgctggctggcagagtttggagacctgtcaggagtagggtgcatactgggtgggaagcctgctggggtgtgcagtggccctcggagggggtccgcggttcccagaaaaaggaatttggtaatctgtggtggcatttttgggtggcagcactggcacctttggcagtggcaagaacacttcctgtctgaccttcatgtaggggaggtcgtctgatgtcccagacctgttataaatatgaaaaaaaaatttttgtgcatagttttaacaggtgttctgaagttccaggaacaaaatcaccttataaatcaaagatgactgtgtattgttctcttcagaatcacagcaagaattcagtttccagaaggaaaagctacagtagttgcttcatggacatggcttgcccttgaggttggtggtgtcagtgcatgagcagcctggtaagggtggttctctggccgccacccttggtcctctagcgtggttgtgaagtcactttcctttactccccattgcatcatagttgggacagagcagtggttctctgccgtcttgtgcgagtgctgggatgctgtctctacttccttttgggttgccagaggcagcatttagagcacagtgtgggcattatgttgtggaccaaggcagcctattgcaaggacctgatcgggcggcagccgtggggcagctctgagtagaacatcgggtcacctggctgactggtgtgctgagaacacgcaggaggaggctggagacggggttcttgcctggggaacaggagggaggctactcgcatcacagcggagaatgcctgttgggtttgggaggggggtttcggctgcaaagctggctgtcaaggggcaggaattgggaggagggtctaaagtcttgaagagaaatgtggggtcgttgtgtaggggccaccatcacctggagagcagggcagatgccagcgtgtgtgtgagaactaggtcacttgaagggaggtccccagagtgtccccggggtgtgcctttctctcacctaggtctggagtgcctccagaagcgaggatttcctgcaagggcggtggcctcccagggtctgtgggggggcatccccgtctctttacatgtctgactgaccagagtggggtggggtggcaaggtggtgctcgtcccaaagctgggggaaacctggtgatggttcccactcccattgttgcacttcgcttttgatttctctggaagagcaagtctttgtgtggtgtttcccctcagcctacatttttaaaatgaacgtttcttgaaggcagaaatcaagttttaggcattggctcaatcactggtgcagccattgcattaattttctttaacctggtgcggagaagctacaagggccccacccccttctagtggttggaggaaggagcaacttgctctcccagtttatgacagcaacaccagcagtgtgctgttccagttccccttttttttttcaagtggtgtagaaaggggccttcagggccctggatcccccagccccacacaatggtgggcctatgttcgtccagaacagtgcctggcagtagctcagtgcccagcatgtctgtggtgagtgtgtagttcaggaagtgaactggcaaaactgagtatcaccctctcttcctgggttcttgccactcccctgaaaaccagggtagcattgtcacatcagatagctccgctacgtgtgcgctgaccatgctgagatgggcactgtggactcagcctctggtcattgctggaaccagcggcctccatgtgaggtacaggggaacgcactgctagcagatggttgggatgtggacactcgtcctgccctcttggcttggtgctgtgccatcgcacagtcattcgctgtttagcatgcatgggagagagtgaagcacaagggcccaggcccctgggagtgcctgccctcaagttggaagagcccttgggcacagcataggcgcctggcagaattggactgggccatgatccagggcattgggacctcacctaggagttggggttctggtcagaagccctgtggagacagggtctcccctgtgggcaccaaactgacctcaaactgctggttctttggccctggggacggggctggttgaagtactctcccggcagctgtcacctgcagggagaggtgggggtaggggtgctgtgtttcttagctgttcctcgttgcagtgttaaatccctgcaggttccttattctcagcttgtgttgtgagtttcagtgttgggggctaatgtgggtttgcgtttttggtcttggttttcccagtggccagtccatcagccactgcactgggggccaggtagaggccaactgcaccctgcctgccagagtagaaatactggtaggccccaggctctgctgccccttccatgtccttgtgtaagcatccatggacaaagctgactcacggggtgtgcacagctgcagggaggccaggaaacaggggttttattctagagggccttgtgctcagtgacagaccagagtcccatcactgagagagcagggctggggcagcacaaaggactggagagcatttgccatgatgccatgtgcacagccagtgcaagtccttcattgtagctgtggtcagaggtcatgagacactgccttcagcagccctgggagtccacctggtgtgtggttagagctgtgcatctgcagatttcagaaggacttacgtttggtgaggtgctttgaagtaacacttcacaaataccaagaagcaagaaatacacaaataagcaggtaatggttctttggtgtttacattagctagtgggcaacggttctttggtgttcacattagctatagtcccagaactcagtccatgaggtggaatcacaaaaatggaattcatttctggctgtcagtacacaaactgatttaagatatcaccttgaattttaagctgacaaacagtgatctaaactgaatttcactgattgccccacctgaaagtcagacctgatagataatgccctcccttaactcaaggccagcagcagatgtgttagaggggacccttgtgcctcgcagccctcatctcctaatggctgtggggtcactgtgtcgagttgtaatgcctaatgagctcctctaaaaacatcctgaaacttgtgtaaaaaaaacagcagactcccagtggaactcgccttcagatgcagcccagaataagagttctagaatgtgtgtgccatccttttgtctcaatctgcatgattgcaagtctcttcaacatgattgggtgcgtggagtgtctcggtcatgtgtcttcccctctgagcatgccttttgattcgcacctgtgtcacaattgtgccagcctgtgagatgtgtctgcctgtcaccagtatcggcacatttagttttccctttacgtgagttttggtaaaatagtgacaaaatgtaatgcagtgctcagtcacagaaaaatgtcaggcctacagaaatggagcatttggctggcgggtagcgtgatgaccataggctttatttggctggtgtggtaaacaagcagcagcttgtgcaggtgagaataaatggccatattgcatttcattttaaggactcccttaaaatgaaaatcttcgtgtgggacatgaacacaggctttcacgaaattgatcatctacactatatgtatgactgttgaaaggctgttgttcctcagaaattcttaaaatgttatgtaatgtacatgagtcccttcaggaagtcatcagctttgttcagtttcctcagattagatagtaaaactgagattatgaactataaagatgtgtgtaatttatctgtcagtgaacttgactttaataaaagctttttgaaaaagaactctgggtggggtgcattggctcacacacatagtcccaactactgtggaggtcagggcaggaggatcactggagcccaagagttcaagatcagcctgggcaggatagcgagaccctgtctatagaaaatattaaaaatcagctaggcatggtggcttgcccttgcattccctgccacttgggaggctgaggtgggaggttcgcttgagcccaggagctcaaggctgcaatgggctgtgatcgaaccactgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatgccaaagtatccctgagatctgcaagggaccgaggacagtactggctggtggtctgggtacaggccacagaggcatctggaccccatgtgcatctggaccagtttggttggatccattcatggacacaaaacggatgtgaactcacagagctacattttctccctgcccctgttcaggcacagtgaggtgtcggggaatgtagctgccagagttgactgtcccgttctttggtgtaatgcctgaaggccacctttaccattggtctgtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgaggcaggacgtgccagccaccctctgcccatatgtgcagcagggccacagatgtgcttgtcggtaggagagaccaagctgtctgtgtgccgatgtcttgacacctgagacttcaggttcacccatcctggttctgccattccattgcagggtggcttccctcctttggggactcttaacgctttggtctgttaaaaaaaaaaaaaaaaatccgggcgtggtggctcactcctgtaatcccagcactttgggaggccgaggtgggctgatcatctgaggtcaggggttcgaggccagccctgaccaacatggtgaaaccccgtctctactaaaaataaaaataaaaattagctcagcgtggtggcacgcgcctgtagtcccagctactcgggaagctgaggcaagagaatctcgaacctgggaggcagaggttgcagtgagccgagatcgcacctgagaggttgcagtgagctgagatcaagccactgcactccagcctggatgacagagtgagactctgtctcaaaaaaaaaaaaaaaaaaaaaagccaccaatggggagggcctgggattactggcatcacaaaccccactgcctgcaggctgcatgatctcctgggcatggttggcggcactgccccgggcatgaggaggcagcaggcatgtgtggatcacggacagtgctggggtcgagggggttggtgacggtgtgacaccccttcccctgagtggctgggtgttactgtcaattctcccaagtgctgtgcttcagtggtcgtggcagtctggtgctgcctctgcccaactggcaggcgacccttattcctgagtccctgctgacttggtgtcctaggtttattcctcctagacttgttaacttgtacagttaacaagcctttgacaccacacaccctcgcctcagctttccaaccccctagtaataacaacatcaggactccctgagtatcctccaccatatgttttcctggagtaactcataaaaggccctcttttcgttccatttcatgcttgggtttttcatgcgaacctgtcattattagtttttccgcattgcctagagttgcccaaccccataataagaatacgtaggtggcgtgccccattcttgcaggtgtccacttcctgctccagtctgagggggttggctaggctgctgctctctctccatgtggggttggctaggctgctgctctctctccacgttgctgtgggctcgcatcctctccctggttccctgggggagcttcttagggagggagcatgtgagagatctgaggccctgcagtttgggagttattttcattctcccctaacacttgttggatactttggctgggtatagaattaaagggtttcgaaagcagtgtttcagagtcttccattctctggggcatcagaggtgtcatttgcccctgtgcattctggagtccaccttgcacctttattgggtctcatctaggtccttggctttgcgcttcagccctttgaggccgaagcccagattcctgggtccccactctggaacagggaaaaatttcaccccgtaatttcgtacgttctttctttttagggtttctgttggttgatatcttaagttactcctcatcttcctttttcattctgtttgtttttgttctgccttctgagcaccttcattttgaattttccttttcagctatttgtgtatctatcaggtttctctccttgtcctttgttaaaatagtcttctgtcttcagtctcctgtcttggttgcctccttgcagattccttttatatttgggtctcttatgttggtggcctttcaaaggcagacaggcctgtctcttggtggggggtgggggtgggcggagctccagttgcttgtgtgtggatctgctggggcatatagaactctcaggaattattctggaatttcatggctcaagtgtgttgtcatggctcagcgcaggcctaagccctgctgcagctgctcccctagaccaagcttgtccaacccttaggccgcatgtggcccaggatggctttgaacccgacccaacacaaatttctaataaaacattgagattttgggggtttttgttttggtttggttcaccagctgttgtgttagtatattttgtgtgtggtccaagacaattcttcttccattgtggcccagggtagccaagattggacattgctgccctaggcagtcccagcttcatcccttgggtcccaggcggtccagttttctctgcctggtcaatcatcacatccaaggtcttcctcccttttctctctgcccttcaaggcgtgtgtgtcattttggtgtcttcattggtagtggttgcaggagtggactgagagggcaggtattcagtctcttctgtgctccatgggtggtggtcttcctctgggcttagaaaacctggccgtccccaaaaagggaacactacagtgaaggtccttataaatttcagaactcatttaaatttcagaataggtgacatgttcaaaaccaagagcaaagtgtccaaaggacactgatccagcttgaaggggttctgtggctcatctgggatgatggcagtgttaaatcagacacgggcggccagttcacacccactgaaacacacaggcatgtgtgggctcttgctgatgttgagaaatggagaagaggcatttccttgccgtagcgtgctggggtgactggatgagagagtcaccagcggacagtcatggctgtgattcagccaaaagccacctgtgtgtggaacccctggtggaggaggtctgatgaggggtgggtgtgctcacaggctcctggcatgtcctcttgaaggcagaagccttcctcactcggggtaagccccgcttgcgggtgcagtgaagaagcagtcattgtttcagaaagtgaccagtgttttctaaagtccctgttcgggataaaatcacctgattcgtgaaattgcccactggccagtgaggccaaagcctaacaacttcagtgtcctcacagaggcgtctgggcagtggaggcccttcctgctggagtctccgcagggctctgatggtgggtgccagctgacttaattgctgtccccgatatttgtgttctgctgagggaacccctacccttgcggtgtggggcagacatggcgggcgtgccccatcgaggctgtgtcctcatgggagtgtgtccctgaaggtgtcctgctgagtctggcgtggccctgtgtgctctggtccttgtgagtgtgggcaggcacagtgagtggtgctctctggccctggaaggttctgtgttggggtgtagaggagccttgcacgcacctggaagccagtcctcaggcagccagcctcccctcctgcataggctgggatgaggcagcctttctggccatgcagctgtggggacagcttcccaagatgagggcaacagtttctcaattcctgactcagccattttccctcagcccccatcctgaggtggatttggggggcatgggaggcagggctctttccctgtttccctgcaggcttccaggaggtggggtgaggcagtggtgcatccctgggtgggtgggttctgagcaaccactgctgggcagcacagaaccagacatggagcaccttgtctctccaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggtgaggtgggggccagcagggagtgggctgggctgggctgggccaaggtacaaggcctcaccctgcatcccgcacccaggcttcaacgtggaaaccgtggagtacaagaacatcagcttcactgtgtgggacgtgggtggccaggacaagatccggcccctgtggcgccactacttccagaacacacaaggtaagtggctggggcctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcgggcccagccaatgagacctgggccatacagggcaggggtcagcaggcaccatggaagacctcagcctccgtccttccctccatcggcctgctgctgaaccccactttgtatagctggctatggggcagggccactgctagcatacatagggctttgtgccaaccagggaatggtccctgcctgagtgggcacagcccccacctctcctcaagatgccatgcagcagggggctgccagtctgggggtacctgtttctgggatggggccatcagcaggtctaaggtctgccttctgttgggcagagtcccaaaagagagggctgccctggctaggtggcccaaccttcatcccccttgacagcacccaagacagcacagtctctactccagtagccacccgagggtgagggcagaggtcaaagccacaagctacaccttggccagggccctgaggaaggtctgcataacttcccttgaaatcagaaacaggccaggtgagggagctcatgcctctgatcccaacactgcaacgctgcattgaactgtgatgcagcccaggtgccatctgtctttatgccatgcagcctggtggccgcacacatcctgaacagccctgatccttcttagggtcaggcagaagggacacccagcccactgcctctggagaagcggagctgagggttggggtagcaggcagttggaggagctccccaacccccacacccaattgaggctgtgcctccacagactgcagtctttgacctcacctgtcgcagggatagggctccctgccccaggttcccacattgccagctgagcacctgcttccagggcctcagccctccctgggttttggtgggggctctgggcacacatgggaggactacattcccccaggacattaagaatcagatgggcaccggggctcacacctgtaatcccagcactttgggaggccaaggcgggcgaatcacctgaggtcaggagttcaagaccagcctggccaacacggtgagacctcgtctctactaagaaataacaaaaattagcctggcgtagtggcagcgcctgtaatcccagctactcaggttgagacaggaaaatcgcttgaacccgcgaggcggaggttgcagtgaactgagatcacaccattgcactccggcctgggcaacaaaagtgaaactcaaaaaaaaaaaaaatcaccaggtctcagactcctgggagacagaccccagctccgacgttccagtgggatctcattaacccctgatactgaccttccaatttgatataccttccttttaaaatatatttattgaaatacaaagagtcaatataaagaaaaatagaggtcaccatacttggccacagttagaccgctcataggcccatggctgctgcaaccatgggcaggacacagagggagtccagcctctactgataaatctgggcaggttcaccttcgcaggccaagccaggggccatccctggtatgcgaaacctggaggttttccaggaagccggctgctccagagctagctgtcaagtctttagccccacaggctggtgcccagagccacttccacaggagcagcctcgggcttcacccacacccaaggagcttccgaggcaggaggcaagcaaggtgaagggagggttcagggtcccacaacagcagtgagcagggtccagccatcaggcctcagagcctctgtcatgccacctgcgagacgggctcctcctgtccccactgtgtccccgcttcctcctctta

SEQ ID NO: 14395 - DNA, 6532 bp, Human
tctgtcaccctggctggagtgcagtgccacaatcatggctcattgcagcctgggcctcccaggtgcaagcaatcctcctgcgtcagcccccaagtagctgagactataggtttgtgccactatgcccggctaattttttttttttttttttttttttttgagagatggggccttcctatgttgcccgggtggtctcaaactcctgtgctcaagttatctgcccgcctcagcctcccaaactgctaggattacaggcgtagcccctatgcccagcctctgtttttttctttggactcagcctcagccagatctcccctgggcttgcaacacaaggcccaaaacaatagaagagaagtgaggggagttttccctttactacctagcatgtaaatgaggcctaaagtagactaaggaagggagagtgtgaagggagagtgggccagagctggggttgtggtgaccaactcctggggcctggggggagtttgtgtaggggagggggagggagtggcagggaatcaagacttaatggatgaattctagggcagccccagaggttacatacatggctgtggcttcagacagacctggattcaaggtcaaatgagactggctccaccatttacgaccttagcaagtcacttaacatctaagcctcagttttttcaccagtcaaatggggataaacataacacctgctgcagggcaccacagagggtatcaagtgagggaatgcataaagcatggagcactatccaggcagctgtgggattcctctcatccccccacccctccctgggccctcacagccactctctcaccccagtccccttccactgtagcttagtcacccacttgtcccttccctcgctcccctcccattcatcctcagctaatacaaacaacccatctgcttgctactttctctaccaaaatcacaaaattctaggtcttggctgggcgcggtggctcatgcctgtaatcccagcactttgggaggccgaggcaggcggatcacttgagatcaggcattcgagactagcctagccaacatggtgaaacccagtctccgctaaaaaaaaaaaaaaatacaaaaaattagccaggcgtggtggcacacacctgtagtcccagctatgcgggaggccaaggcaggataattgcttgaacccaggaggtggaggttgcagtaagccgagatcatgccagtgcacagagcaaaactctgtttaaaaaaaaaaacaaaaaaaccaacaacaacaaaacaaaacactaggttttaacaaacttcagaaataatctatttcagtcttcccagttccttgaaatgaggaactgaggcctagagagggaaagcccaactgaaaccaggcttaccgattcctcacctccagcaccttcacagaaatccaccaacccttccacaatctaaacatttcccaagctttcattcagaacctgcagcccatctacaaccttcccttgaaacataaatctatcccagcccttctccttcagctcctataccctgccccaatcttctttaaacaacaaactcatttacggaatatctgctatgttctggctctttttagattggttattattacatgtaatccggcagttcttttgttaaagggtcagagaggtagagtttctggcccagggtctcagagctggtcagtgattaaaccaggattcagcctgcaggatgcatgattccaggcctcgggccctacttactcccaccgttgcctctggattgacctctctcctatcttgtacgatctagcctgctcccccagccagggccttagaacctagagcctggtattatccacccccagatctgcagaaaggaagccacacccctcctccaccttgtaagccctccttcctctccctacctcaccccgcctcctctgcctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacaggtaagagcaacgcctggcaccactgccaggactccccaaagttgcttggcatggagggagggcatacaggatgtgagctcccagagacccagccttctctcctgagagcacagcagatggactccaacaggaaaactggggacacagcgggcctggccgcccagccttccagctcttctggctggggctgcactgcttgcgggctgccctgagagaaacctgtatccacagctggggagcacttacagggtgctaggcgcgttggggcacccaaggggtgttgtggaataatagagaactaagagacttgggaagacaaccctgagtgaggaaggcatcggcccacagggagtctggggagatggtcctttggggagaggccaggagatgtccaagtggagcctgctgtggttatggaggtgacaggggacactctaacccccactcccctgccagagagaagcctggatgttcaggaatgcaaagaagacaggactctcccatttcagaaacaactggagtctcaaaagcgactgctattccaggaggcagctttggtagcatcccaggtgcccagaggggagtcagtacagcagaccggagccatcaagttcttgatcaagaacagcttgatcaccatcaaaaccagcttaatctccatcaagaacagttctagttgcagctccatcaagcattaaggacagctcgatcaccatctggccacttccccaccccacatccagccacccacgctttgccaagtgctttctcactcagccctggctcatgtgaccttcacaactgtgatgaacttctccccactcagaagatgaaactgaggctcagggaagctaagccctttgccaggctaggaaggtcaagggccagggctcccctgtctccctctatgccagaagggctggtcgctggggaaaggtgaaaagaaaggttctgtgaccgggcacggtggctcacgcctataatcccagcactttgggaggccgaggcaggcggatcacctgaggtcaggagttcaagaccagcctggccaacatgacaaaatcccgtctctactaaaaatacaaaaattagctgggcgagccgggcgcgctggctcgcgtctgtaatcccagcactttgggaggctgaggcgggtggatcatgaggtcaggagatcgagaccatcctggctaacacattgaaacctcgtctctaccataaatacaaaaagaaattagccgggtgtggcgtggtggcaggcgcctgtagtcccagctactcgggaggctgaggcaggagaatggcgtgaacctgggggtgaagcttgcagtgagccgagatcacgccactgcactccagcctgggcgggcgacagagcaagactctgtctcggaaaaaaaaaaaaaaaatagctgggcgtgatggcggctgcctataatcccagctactcgggaggttgaggggtggaggttgcagtgacccgagatcatgccacttcactccagcctgggcaaaagagcgaaactctatctcaaaaaaacagaaagtttctgtgaaagggggtgggcaggggcagtgatcacctctgtccctgcctgtgtcaaagcaggaagcagtcaaacatcctgacaggaccttgtggaagaagtagtggtcacatggggcagaactgaggactgttttatggaggtgggcggatggagggcggggagggtagaaaggggactgcatctttaaataacaaacacgctattcaaaagtcccctgagggctgggtacgatggctcacacctgtaatcccagtactttgggaggccgaggcgggtggatcaccaggtcaggagttcgagaccagcctgaccaacatggtgaaaccccgtctctactaaaaatagaaaaattagccgggcgtggtggcacgtgcctatagtcccagctactcaggaggctgaggcaggagaatcacttgaacccgggaggtggaggatgcagtgagccgagatcgcatcactgcagtccagcctgggtgacagagtgagactccacctctaaaaaaaaaaaaaaaagtcccctgatcttatcccacttctcctcctacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcagtggggtcctgcttgtggttactggacatccctacgccccaagagccagctgtgcagcagcaccagggagtttcccatgtccccatcagcagggaaattggcaccagggagcagcccccagcttccccacctaaattccaatgctgagggcccttccccttagaagcacattgcagggacaaggcccagaacctggcagcctcaccaaccctgcagttgcgtttgcttcatccatccctgggtgtttgggaatgatggtactagagatgccaccaccctggacatcccaggctcagagagcccctaccccactacctgggtgtcttcagaatgacagatccagggaaatccccagtcccagggacacccctcaacaaggtatttagatccccagcaaaccagccccacaggcatctggggctggagaaggatgatgggtggctgtctacctcccacgctggcccaggggctgggaaggcaggaagggcaagcagctgctctgaccactcccaccctcctgggcttgaggcatcggaggtgggtgctgcagagatggaagggagccccagggcaccccccaagggcccctcccaccttggcttcttccttgaggacctccagggacagagggagctccctctcttctatgtcctgccctctctgagctgggttagagacctggatgccctgtcctggcttctctaagaccagagttggggtgagtgcagcagagccctgggggcacagcccttcagggtgtggctcacactcatctcccatgcctggcccactgcacccccatcacactaacctccacgttttcaccctggacttgtatgcatccctagaatattctttctctgcctcctggagcctggctaactccccaccctaatatctcagctgcaggtccctgacgtgtgcagagagacatctcagcctgccctgcacttgtgggggtgatgttcctgctgtgtgagtccctctacttctttcctcccttctcatggatgcatcactctacctgtcaggatcctctgtgggactgtgcgttccctaaggacagggaccgaaaggctcagtttgtgtctgtgcccgcacagcctagggccccacccggctcagagcctgctctcacaacacttcatttgggtggctgcgcgagactacactccccagttagtctggtcccagggcgccctctgatggcagaaggaggcctaacatctgaacccgaaagctggggcctggagggaagaagccagcctgagcgtcagggaagaaggcaagtgaacaaatccccaccccaccccgaaatatcaaggtgcacagagacaagggtacctggcagcatattagaaaatagcttatgttacaacaaaaaccctataaaaacattcatcccagcaaaagcctccagggctggagggtgaggggaaaagtttcaaagcacgtggatagtccagatctgggatgccctgtcctcatccggctcccatagcaccacgtggtcccggtcgtagccccggcctcctgcgggtgggatggggattaaaagatagggagatagtcagagagagctgggactccatggctctcagccccctcaggagccctcttccccatacatcccaccttacccttcacgtccaggatctggccttcgaacatctggctgcagatgtggcccgattcactgatgctccacgtctggcgcggcaggcggctctcggcccacagcaccaccttggagcctgggctagggggtccaatcacctgtaggctcatggtgggggccatctgaggccccaggaggtcatcaggcattgttcctccccacagggactctactgtacccaagaaacccttgacccatctgctctgaatcctggctcttagggactgtggccctgggcaagtctcttaatcctcctcagcttcagtttcctctcggggatgggaatccccaaatgctggcttttgtgagggttcagtgtgaga

SEQ ID NO: 14396 - DNA, 10143 bp, Human; identical to SEQ ID NO: 12090

SEQ ID NO: 14397 - DNA, 10143 bp, Human; identical to SEQ ID NO: 12090

SEQ ID NO: 14398 - DNA, 5538 bp, Human
tgcctggcccgtgatttttctagaaccctctggacttgaccgttttgccacagaagtctgcaagataggaaaagaaggatcttctcttcggttattcaggagttcctacagccattattttgcctttcctgaccaaatagctggcacttgacggctgtagcatgtaaagactgacttgcccactcacaggttttcttcctcttttcttactgaagagcctgtccttgaaaaaaacattccaggaagaaatctttcttgggccacagagccctgtggtttgatggaaaagaacgaggcttcaagactggctctgctattacttgtagtgtgacattgggcatgtcttaaatgccttccttgggcccctcagcatctttcacctacatatccaaatttcacacaaccttggacttctacaattggaaaggattttaaataatcacttagtaccatcgtctattttactcacaaggcaattaaagccagagtacctgggcttgttcaagattacatgacaaattattgtcagggctagcatgatgaacccagggctctcaattcccagtcagtgtccttttcaaccgttttgcgactctctttggctctgagccccccttgtcctgttaatcagtgccacacattatcgaactcttgtttcctgtgttaatcttgtctccccaaattgtgagattcttgaaagcaggagccactgttttatgcggagggactccataaatattcaccaatgattcattaggaaagcaactattgggggaatcccacttggtcatttccaaaatggaaagcagcatcttggaagtgcaggtccccaaatgtctagggaggtgacaagaaggcaagcaaagaatcaaagaatactgagcacagtgtcctgttgcaatacaggacttagtttgccggccctctggttcctttcctggtctttcagatggagctggagctacttcagcagggctaagaataatcaagtccaggtggcctgcccttccatagcagaaagggacagacaatagagcaatgaaattaccactgttttctacacagaggtgtgtggaaagtgaagagaggggaagttaagaaatttgctgacccaattgggtgggggggggctcttaaaaaggtttatgtagaaattgtcccatctgtgcctccatatttaaaaccttgtccaaaattctaattgaactcacaaagcacaactgtgcatatatttagttcgttatggagtttatggggcagagggtccaggctccttttttccccatgcaaaaagcatgggctcaagctttcttcttttcccctgttgctcaaataaatagtgttctttgctcaaaccccctttccctcctccttctgcaatctcagcgcctagcgcaaatctgttttcttcattgtaacctcagcttcaccgcaattaattttttttccctctggtcacaagataattcctgacgccagtgagtctggaggtcagacgaacagcaaattggggaacaaggcggcactaattccttacaagtttcccttgaaaaatctttcgcttaaaaaaaacggggggtggggggagcttctttgctgttcagggatttatgacctcggaggagctgtggctcgaaccagtgttgggctaaaggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccaggtaagcctcgaagtcggggcagggctgaacacccaggcaaggatgctgcgggaccctcggagctcccgattgcctcgcgtaactcttccctcttttcctctaatcagacagccgagctcgctccggaacttgtcatctccaacgacaaaaggagcttttgccactgactcggccgtgtcctgacacctccaggtgagtatctcctctcttggagagggaggtttaaacggcaagtcctggagttggcagacgttttgaaaaattgccactcactcggtttagggaaactgaggccagagagggacaagtgacttgcccatggttgcatcaaatgaatggcagagtcagtttccatgtgatgtgcatttaagccttaaatgcgcctgggccctgccctcccgcagtggccgagggtctggcaaagtagacatgggtccgactaaatacaagtctttctgttccatgttgtatagggagctgtcttcggcagccccctcccagctagtgtcaattccaagtaggaggggtagcgcaagctccgcctgtggtctttggcgccaactgggtgggggcagcgtggggcgcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtctcttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatgacacccgtctccattaagtactaatgatgctttctcgcacatggccgaattttgggagctttgggaaagtgaacttgcttattctacgagagggaaatgaaaaactgcctggttgagaggggatggggtggagagagaagggttcatgatgggagtctcatgtccattgagggatgggtgcagagaaaagttctgggctctgcctcattatttcagagatgaaaccagagactggtgcaagcttgcccagcaagttggtggctcaggcaacttgaaagttggtggctcaggcaacttgaaaactgagttttcatgtcccttgagatctagcagtagctttcctctttattgttactattgactatgcctttctagcaggggatgtggtaagaggagagcctcaagtttgcttcacctggtgcccaggcatgggtggtggttgatagaccaattccaaaaatgaataaactgataactgggcctggtttcatttccttcttgctctctgggctggcttccttgcgggcttccaaagttggaaaaaagagggaggtctcctgaaatggataaagatttggatgctggttgggaagtactgatagtaatcccttctttaatgctaggtggttgtggagtccgaccctgaacaaggaatgtgaggcagagactccacagtcctcatttctgctggtatttctacatcacctccattgggaacctattctgtaagcatccctatccctatttcagaaatggggaaagggaacctctgtgggtaatgcttctgaaccaggttttcacagcctttgagaggtagagatgggatttgaaccgtgacttgattgtggtgaacaggagcagggctggggactggccattccttgaggccaggcctggcagtggggcagagagcaagatcccaacccatgccttcccccacacccctggtggctccccaggtgggcttcaccaggtgcctggccttactagagattcctgtttatggtatgatctcatctgtgtgttggtccctggcatgaattacttcaatatttcataacaaacaggtcacgtcatcacctttagtgccttaaccctggtgagcttgctggggtgaacaggggcatgggggaggaggagaacctctggcattgccaaccaaactcccagcctgatcagtggttcttaacctgttctgtgtcctggtcactctgatctgaaggaagatatgaacactctcttaaaaaaatacacacacagtgcagagcaatagcagacttcaatcctcatgtgaggaacccttgccccaaaccacctacaaggcctgggttgggtctatcttggattgttttttaggtgtgctgtgctggctttagagacgaccataaagggacataaatccctgctctgtcacctcttacctgtataacttcaggctagggactttgcctctcttgagccccagtttctgcatctgtaaaggaagctgattctaaggcagcggttctgaggtcctaggccccacattacaccatgaactgcagtagagccaggcattgagctcaacgtcttatacccttttctgccacagcatgttgcctcccgtttgctcggaagtttcagtaccgtggaaggctaaaaagggctgcggtggtcatctgccgagtgaccttgagcaagcattccacctctctgagccatgctccttctgtgccctgctgcctcccaggacagaagataatggtgggaaagttctttgaaatgcatcacacacctacgaggtattattaagctaattccaaggaaattgcctgtcaggactcccaggactgagttgttcaggtggccaggacaaaagaaagaccagcatgccaatccattagtcattagagagtgaaagcaatttggccctaggtcagataactcccagagaggatagtgtcttctgtcataatcacctatggaagtgcctgccagg

SEQ ID NO: 14399 - DNA, 7825 bp, Human
gggattacaggcgtgagccaccgcgcccggccgctgttaagtacttatatgtgaataagcgtaagaaagtattgcttatcaatagcatatacatttacagtctggaaaaatggttaggccaaccaaccagagattgtccacaagggtggctgagatagtgacacctttgctttctgatggttcaatgtacacaaactttgtttcatgcacaaacttacttaaaatattgtataaaattaccttcagactatgtgtataaggtgtatatggaacataaattaatttcatattcagacttgggttccatccccaagatatctcattatgtttatgcgaatattccataatccggaaaaatcccaaatctaaaaaccgtctggtcccaggcttttcaggttaggaatacgcaccctgtagtaacttgcccaaggtcacatagctactagctggtcgagacaggaccacatctgcctgtcttcaagctcgggactcttaaaccaccactcctttccgtttgtataaattctatttgtgcccggagtggtggctcacgcctgtaatcccagcactttgggaggccaaggcgggtggatcatttgaggtcaggagttccataccagcccgaccaacatggtgaaaccccatctctactaaaaatacaaacaaattagaccggtatggtggtgcgtgcctgtaatcccagctacttgggaggctgaggcaggagaatcgcttgaacccgggaggcggaggttgcagtgagccgatatcgcgccactgcacttcaacctgggtgacacagcgaggctccgtctcaaaaaataaataaataaataaattatatttgtttacgttgttacagaataaatttgcgtcataatttgcatgattgatttaatgtagttttggcgttctcatcacacaaggaccaccagctcgtgacactgggaggagagaacgtcctcaaggtccggaaactcaaggacgtgctgattcgggagctttcaaaaactatttttggaaaacccagatcccggtcttcagccagcgtcgcctgcagtggctagcactacccacaagggagaagccgacgctgcagggctttgccaaatgcgcctctcttcctcgtcttcatctctgtggttagcctgggaaaagagcccgcctcctggcccataaggccctgggccggaagctccgctttctcttcctgctctccatcatggcggtgagtagctgggacctggatttgctttcctttatccgtcgccatccatggcaggccgagcctgcgggggctacttcgcccgcagcccgaggaatatggagcccgcaatgcctgctggcccaaaactagcagagccgttcgagccaaggacgcagggttgaattctgtcactttccctgccatcgttttaggagcggctccgggcacttgcccggagtgctcagaagcacggtcaggaggctgcagcgggggcagatggggtgaatggagggttctgaggcaggggggtccgggccttttcctggtcccggggacttgagacttgctcggtgctaggaaaccttagtcggttgctccgcttagggaaggtgccagcctttagacagcttccgaataggatgctggacgtcgcataaccacgtgtttcctgttaactgagcaattaagttctgtttcttcgctcactccccttagttggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgactgctgctcttccctgttgcagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaaggtgagtagtcacaaggacatacagggtttgcctgcttgggtcgcttggttgtttcttgatttacctgctgtcgagtctgtttagaaagtgacagtcggcatcacttaaagcattaaattcatgagccggccaagaggtgtcttttttttttttttttattcaagatggcgtgtgggattggaacactagattttatttgagcagatcttaagctaagactagcccaagtaaagattttcctaagtaactaggatatgagatagagtggaaatgtcaggaacgaagtaaagatcattagatctgattagcagttagggttatataggctgcattaagaacagggctgtacgggagcatgaggcttcagtggcctatattagtgccactgcactccagcctggttgaccctatctcaaaagttgtatacagattgcctgggtttgagtgatggcttcaccatttgctggtctgactctgggctctctggacctctgcttttttctttgcataaagagggtaatactttataattgtggaagataaaatgagttgtacatgtgtagttgctttaggacagtgaaatatggcaagtctttggattccactcctgctttttgttaccagctgtgatgtttggcaagttaataaacctctcaaaacctcacctgtaaaatatggataacagtacaataaggtttcagcaaatagtagatgttgtcaataatgctttgttttctttggaacatgataatcttactagtggcttcttcggcctattctggttgtgaccttgcccttcctggaacttcggcgttatgactgttcttaactgctgaaggatggctggatgtctggaaatgggaaaatctgtgctgtggatgaaatcttattaatagatgtgggagacactaattagaacaccacaacttaaaagagtgtggatgaatgcttaatgtctctttaagtcatggagatggtgttctgggaaagaggtgagtgtagtgggggtatgatggcatctgactccttgttacccacttcctgcagctagatacactgtcagatcctttggcatccggagaaatgaaaagattgctgtccactgcacagttcgaggggccaaggcagaagaaatcttggagaagggtctaaaggtgagcctaatcccctaatggagtgatattgatcagcactcctttagtaacacatgtagataagttacatttaatgttctgttctttggtgtcttgatatttatttacttaagcttctaaaaggctttttctacaatcagcagggttaaactgttcttggtggtttaaaagatgcttgaggctgggcacggtggctcaacgcctgtaatcccaacactttgggaggccaaggcggttggatcatttgtggccaggagttcgagaccatcctggccaacatggtgaaacaccatctctactaaaaaaagataaaaattagccgggcttggtggcgggctcctgtagtcccagctactcgggaagctgaggcacgacaattgctagaacctgggaggtagaggttgcagtgagctgatattgtgccactgcactccagcttaggccacagagtgagactcttgtctcaaaaaaaaaaaagaaaaaggatgcttgggagtcatttcatgcctctgctttctctgggtttttctctgctctttggaagctgggagaggtcatactgggtagttggggtgtgaatctatagtcgaggtatagtgaggaagtcaggttgtgttctcagccaagtttcattgacttctgtttgctctggggtgcatgttgcaggctgagctattaatagttacttgggggtgggagggagttgaagatgacaaggaatgttattgctgcatttttctccacaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagaattggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttacagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatccaaaagagcaataaaaagttttcagtgaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgctgtggtgcagtagccccatttggaggggagggtttggttgatgttggggtttgaatttagagccttgattaagcagggtgcagtgctcctgtgttccaggaggccccctgctattcagtgattctgttctgtactagaaattttatcagcattgatgtgtcatgaaggaatgacaggctttggtgtgatggttgagattaaatttagacttaactgttcaggctcaggtttcttttacaatgagagtataaggttcttgggaggcagtatgtgcagataagagggcagtctttccgtttccagccctttcctttaactgttacctcgggtgagttgttaatctgcctcagtttccttatctgtatcaggaggcagtaatagtagtatctctcagaggattaaatgatttaatacttaacaaaatgctcagactagcaccagccacgtagtgctcaaaaggggtttcatttttgtgtttgggtataagaaatattacttctgctagcttgcttccctttggtgcaaaaatgaaaatactttccctgtggtgattgtcttttttttttttttttttttttgagacgagtcttgctctgttgcctgggctggagtgcagtggcgcgatctcactgcaagctctgcctctgggttcacgccgttctcctgcctcatcctcccgagtagctgggactacaggcgtctgccaccacgcccggctgattttttttatttagtagagacggggtttcaccgtgtcagccaggaaggtctagatcttctgacctcgtgatccgcccgccttggcctcccaaagtgctgggattacaggtatgagccatcgcgcccggcccctgtagtgattttctatatctaactgaagtcgatgctcaaaagccgccatttttgtttgtttgtttttggtggtggttttttttgagacagagtctctttgtcacccaggctggagtgtgcagtggcatgatctctgcaacctccgcctcctgggttcaagcaatcctcccacctcggcgtcccgagtaattaggattacagccatccaccaccacgcccagctagtgtttttttgtagagatggggtttcaccatgttggccaggttggtcttgaactcaccatcccaaagtgttgggattacaggcgtgagccactgcacctggcaaaagccatcatttttctgacgcaatacttggccattggttcatcattttcaatttcaggtttaaattttggagcgcatgttaattcagttagataatttactaatttgtgactaattagagttcagttgtccttgggccacccgttcattgctgttcagaggttctcaaatttgctgcttttgtaggtattttgaaacctggaaatagattatttggtgtgcctcatttttaaatgaaaataaagttaccttatcctgtaagatgagctctagttggtgaaaggggagaatcgtggaacatgttgccatatactttttatttcatttaaaatatgagcttttcatttctcaatcttttactacagggccagggcccccacctcaaatggggtgaaggagtctcattcttaaaattcatcttcatgtttataggggggaaccatacttgttttttactaacttctgaattaaataacatgccataaacatgtttaagaacagatctggtgaatggatagttaattagtgctgggtgtggagaacaaatgctggtttcatctaagtaaagcatttcagaaatacaaaatgtagaaagtctctcaattttaataatataaacctgctaagcct

SEQ ID NO: 14400 - DNA, 5189 bp, Human
actggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttggtaactgtgtatttctggtgactgtacagtttgaaatacttttatcaagttttataaaaatgcagaattttgttttacctttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttcccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccactgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgctcctaaacatccacaatacacaggacagc

SEQ ID NO: 14401 - DNA, 16470 bp, Human
  misc_feature (1)...(16470): n = A,T,C or G
gccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtattttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtgatggagaaggtctggtgtggcgtgatggagaacctgtccaggtgaggaaccctgtcctagggccaggtatggccacatttcagccctgaaatgactacagcccttcttctgtggactctggagaagccacagctgagttgctctgcccacagggtggtatcaggatttcaggactagggaagttgccacttgggcatctgtgcaattggtccttagtttttattgtgtataatacaaacttataggaaaacatttcaaacagttctagataaagtaatggatctctccttatcacccatcccattccccagctataaccactgttaagtgtcttattcatgctccacccttatcaggtttagtccttatactcctatctagtaggtctttatacccatttacaaattaagaaacagatgtgtagttgactcactcaggttcacacagcttctatttcaaattggactgactctcaatctggggttaagactgttcttcctggctacaagaaggcagagaccatcccttcctcccttcactggctcagcaaatatctcctggtgtccattctgggccatacccttaagcactagggtgtagcagggaatgaggcaaacctgcccctgacttcacggagtttctttcccggtatttatttaggggtgcagaggccaccagaatccacactcaggctgcctaaccccttcccagggcccttcccataagaccatgggtttgccactggtaaacaggggctatttgacggtcatggtgctggctgccatgggagttggggcatctactgccaagggtccctgatttgccaatcttggccctgcttgggagagaggacccagagctgggaaccagatggaggggcctgactccccatggcttacactttacctgaactgtccaaaagcctcaagccttgtctctctcactcccctccctactagggtttaaccaaagagggtgagaagaccagctatgtcctgactgacaggctgggggaaagagacccccgaaggtgagtccctgtgccctggttgaccagtgctgtcagggagggagtaccagtgagcaaggaggagctgaggcccagagtgatctcataagcccgcctctgctctagcacaatcatcctcacatctcattgtttgcttttaaaagcatgattttttcctaaccataaaaataatgggctgggtgcagtgacccacactaccctgggaggctgagtgggaggatcacctgagcccaggaggatgaggctgcagtgagccatgatcacaccgctgcactgcagcctgggcaacagagtgagaccttgtctcaaaaataatagcaatgtttgcctgtggtaaatacaggaaagcacaaagaagtaaataactaccgttattccactccctagaatagagatgaacattattaacatctcagcattcatgttcttttttttgagacgaagtctccctctgtcgccgatgctggagtacagtagcacgatcgcagctcactgtaccttctgcctcccaggttcaagcgattctcatgcctcagcttcccgagtagcagggattacaggtgtgtgccaccacgtccagctattttttttttatttttggtagagaaagggtttcaccgtgttggccaggctactctcaaattcttgacctcaggttatccgcccctctcagcttcccaaaatgctggaattacaggcgtgagccaccgcacctggcccagtattcatgttcttggtgtatctttccggcatagttttttttgttttttcgggggggtttttttggatttttttgagacggagtttcgcttttgttacccaggctggagtgcaatggcacgatctcggctcactgcgaccgccgcctcccaggttcaagcaattctcctgcctcagcctccctactagctgagattacaggtgcccaccaccatgcccagctaattttttgtatttttagtagagacggggtttgactctgttggccaggctggtctcaaactgctgacctcaggctatccacttgcctgagtctcccaaagtgctgggattacaggaatgagccaccgtgcccggctcatcccggtatagtttttactagttaagattgtatcctgacttcttacattccatgttataacatggacattttatgacaccattaaaaacacttcttagacattatgaatgtattttatatagattgaacactgtttcagatgctttcagacactgggagtatggtggtgaataaaatagcccttgccaacaaagggagacagattcactcatataattacaaaactgagggctctggaaggaaatcctgggtactccactgaggaatttgctctagacttagcagcgaagtggagtcaggaaggcctccctaaggaagtcgtgtttgctctctgaagcctaagtatggcatcaccacagcccagcctgttctccaatgaatggcccgcccatgttggccgtgttggttttagatcttgggtctaaaagtttgagcctgggagatccgaacatgattttaatatgcaaagagggttccaagaccaaggcagtgctttgcaaagacaactttggaaatataagactaaacagcagcgtactttacatggttccaaactttgctacttattctctctgacagcaagacatgggatccatctggtgtttgtaccacaaccctcccacatgcactcttgtcacactgtgggatcctctgggtagtggatcctggaagcagacaggttgggctcagctggatgcctcctgggtgccctttccccaagtccccggagtactgtgccagtcccttagcctgaggctgtctccccatctttgtagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggtacttgacaccccctgtaccccctgctaccctctagagccctgctccaagaaggttgttctttgggtcagataaatgggactctgggaatccagagtaggacgagggtttccacctgcttgagggttgagagaattttcctatgtgaaggggaggagggagacggtgctgagcagggggaccagcagggaaaaagggttgggggtcaggggagctctgctgagagccctgagatcagtggagcctaggtctggaagctgtgcttgaaaaagggattaaggggcagaaccctgctgcagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacaggtaggacagcagctggttgggctggctggggaagcaggagtgcccttgaagacctggatgtgccctagaagcactgtgtgatgctcagcaagttcttgctcctcttggacctgcgttttccccgtctgtaaaacggggccggggggctggactgtgggctctgcttgctttggattcactttttttttttttgagacggagtctcactcttgtcacccagggtggagtgcaatggtgtgatctcggctcactgcaacctctgcctcccgggttcaggcgattctcttgcctcagcctccttagtagctgggattacaggcacccaccacaatgcctggttaatttttgtatttttagtagagacggggtttcaccacgttggccaggctggtctcaaactcctgacctcaggtgatccgcctgccttggcctcccaaagtgctgggattacaggcatgacccaccgtgcccagcctcatttattctttcaacaaaatctgatgcctcatggggcccatgctagatattgagggtaggattacagagacagattcagcaggcagagttggtgtcacaatggtggggagtctgaggcactggagagcacaggagaggtacttactccagctgggttgggggattccagagaggcttcctggacaagtttgcagtgtctgagttttacgggaaatccacatttttaacaagctcctgaaggtattgattctgatgcagccgaagttttgggatcacagaacaagggctttctctgctgtgccaagatgtagggtaaggtgtgagaggttctgggctggtaagggaggaactgcagcctgggagtcaggagaggctgtagcacctctggtaggacagctggctccatcctgggagccatgcctctgttcccaggtatacatcaagtttgtgcaggggcagggtagtccctgctacttctcgtaggatcctctaggggatgtctaattccccaagaggactgaggctattctggggcctggagcctccatttcctgacctgtataattggcctcatagcactgccgcctcctttccccagcccctcctcccacctcgctggagtgaagtgaagtgaccacttaggagggacaccacagggctttccagggtgaagggcctgggatgggaggggggctaggtgaccctctggagtcccagcccaggcctggtcagccttgctgctccctctgtcctccacctcactccccgtatagcctggctttggcccttcaaagagactgtgaggaaatgtgcccggagctgggtgaccgccctgcagctcatggagcggaaccctgagttcatctttgcctgctcccaggtcagagggacagctgtgagggaggagggaagcacgtggccctccctggagctccacaggccctgaaggcttcccaggcctggggtcagggctgctcctcaccctcagccacacactgagtcccatatgctcagtcctgggtggggcccttgtcactctggtcccagctcccttcaacctgcccacaggcgcagcagctggaatgggtgaagagccgctaccctggcctgtactcccgcatccaggagtttgcgtgccgtgggcagtttgtgcctgtggggggcacctgggtggagatggtaagtgcactgggcactcctcagccttgaactgtatgacaacagccttccctcaggtagccccgccctcccggctttgctggtgagtttccacgggccactcatccccgctgtgtggcagggctggctcattagtccctgggatctcaaggcctgggacttcaagggggaggagagcctccagcgctgtgacaagttgcatggcctagtcctgggcaccccctcaggcagatggacagtcaggcctgaaggacaggggcccttcctgagttctggctgtaactcccatgtttgagcagccctggcttctcctgcagggattgggttggcctgagcgcctgcctgctccccgtccagcgctgacctgggctgcctcccacttccttcactgccaggatgggaacctgcccagtggagaggccatggtgaggcagtttttgcagggccagaacttctttctgcaggagtttgggaagatgtgctctgaggtaggctgagagctgctacaccaggctgtgggcgagtggggctggcgctcgacttggagtgctgaggggctgaggctggggtgagtccgcctggagctctggttcctgcactccaggatcctctttctccacagttctggctgccggacacctttggctactcagcacagctcccccagatcatgcacggctgtggcatcaggcgctttctcacccagaaattgagctggaatttggtgaactccttcccagtaagcaggcccccggggggtcagggtcagagtgggcctcagtcccgcctggcccatttgcctctcccccttattgtggggtcctagacagaccaccaaaccctcactctgcctctgccagggtcacatagcaggcaggggcaggaccaagtctggaaggcctggctctgcctcagccctgactctggcctctctgccctgcttctgtttccctgctggtagcaccatacatttttctgggagggcctggatggctcccgtgtactggtccacttcccacctggcgactcctatgggatgcagggcagcgtggaggaggtgaggggtcacctagggtggtggggtaggggcaggctggagagggctggcttgttccaggctgatccatgctggcctgccctcacctgtctaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccaggtcaggccgggccttggctctcctttagccccaccctgggcccttgccatgagccctgccttccctcagacattgggcccaacccctcctctggaccttgtcctgtcccaatcctagaccacgggttcctccaaacttccaccctgggggtgggtgggggagaagctgaagctggtaagggctccagcccatcagagagagaggctctcctagggcgtccagggctggccatctgtgaacggggagctttctggagtggctcctctctgtaggagctggatcctttgctttggtgtggaagaagggtgagccatgtggtctccaaggctgggagacctaggcttgtggtctcctcagggtgcagctatcttctccaagacagctcttctcagcactggagagtgactcagagcagctgtgcacgtgggttggggagctcttcttggagctgcacaatggcacatacaccacccatgcccaggtcagggggaggttgcagggctgtgcagggagggtgtgcccttgatctgcagagggtcagagaaggcagcaggggacagagcccaggccagatctaggggaagagaagtttggaggagagaagttcaagacctgggttggtcaagaaagcttgaaggaggcagaaacccctgaagaaagaagggtttgggctgcggggagaagagggaaggcatttaaggcaggtcacccgccagaggccttctccacgaggcccttggtgagtcctcagggattctgagcaagggagggctttggaaggtgtcctgggacagctaagcaggctccagactaatcttcccatcctgggctcagatcaagaaggggaaccgggaatgtgagcggatcctgcacgacgtggagctgctcagtagcctggccctggcccgcagtgcccagttcctatacccagcagcccagctgcagcacctctggaggtcagcccagttctgtccctgccatccacctgactgctcactgcagttacctctgtgcctgcccctcccagccttcccatccctgcccttggcccctgcaggctccttcttctgaaccagttccatgatgtggtgactggaagctgcatccagatggtggcagaggaagccatgtgccattatgaaggttaggctcacaatagtcctgcctgctctctccaaccccagggctgagcccagagtgtcccctgtgggatacccatgggcacattccagacctgttgcccacctatgaccagccagtctttcctcagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcaggtgccaaatcctcattgccctttcccagtgcctggcaagtagaccccaggccatttcctctctccccttgccacaacactgcccacagcagcccaccagtggctctgggctggaacccacacatggagcagggcaggctgggcagtagtcccctgtccactgggtctactcactccaccctaccccaccaagagcagctggagacagcgaggtgcagttggttgtacagcaccaatcccatgtccttccagggaggccattgctgagggcgccgtggggaaccagtttgtgctatttgatgatgtccccttgtactgggatgcatgggacgtcatggactaccacctggagacacggtataggctgggcagcatgtggtatgggctgggcagcatgtggggatggtggaggtggtgggaacacaggctgctctggatcagtatgtccactcctgtcccataggaagcctgtgctgggccaggcagggaccctggcagtgggcaccgagggcggcctgcggggcagcgcctggttcttgctacagatcagccccaacagtcggcttagccaggaggttgtgctggatgttggctgcccctatgtccgcttccacaccgaggtagtcggggggtagggggtggctgttttccccaagtgtgcttggtaaggaggggccagccccaggccttggtgtgtctcttccttccctgactcccaccctccttcccactcccaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtctgacatggcagggtgggagtggccttggactcctccctggctggggagactgcttgtgtggaacaggctggggaggaagaggataatcaacatttgctgcttcctaacgtgtgtgccaggcattgcactaaatgctttacattggcaaggcacagtggctcacgcctgtaattccagcactttgggaggccgaggtgggtggatcacctgaggtcaggagttcaagaccagcctggccaacatggtgaaacgccatctctactaaaaatacaaaaattgggccgggcgtggtgactcacgcctgtaatcccagcagtttgggaggctgaggtgggtggatcacgaggtcaagagatcgagaccannnnnnnnnnnnnnnnnnnnnnnnnnnnnnnnnnnnnnnntcctggctaacacgatgaaaccctgtctctactaaaaatacaaaaatttagccgggtgtggtggtgggcgcctgtagtcccagctacttgggaggctgaggcaggagaatggcgtgaatctgggaggcagagcttgcagtgagccaagatcgtgccactgcactccagcctgggcgacagagcgagactctgtctcaaaaaaaaaaaaaaaaaaaatccaaaaattggccaggcgcagtgttctcaggcctataatcccagcactttggaaggccgaggtgggcggatcacgaggtcaagagatcgagaccatcatagacaacatggtgaacccccatctctactaaaaatacagaaaaattagccaggcgtggtggcacatgtcctgttatcccagctactcgggaggctgaggcaggagaatcgcttgaaccctttaggcggaggttgcagtgagctgagattgtgccactgcactccagcctggcaacagagtgagactccatctcaaaaaaaaaaaaaaagccgggcgtggtggcacatgtcctgttatcccagctacttgggaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttaggcaggttgggtggcatgcccagggccccgtacagtgggagctggagttcagttgtgtggttctagagcttgtgctcggcctagtgacaggagctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggtgagtgctggggacggtggggccttcctgcagccctagacacctctctgcccttccctgagcccaaaccccagcaacctggcttcctgccccttctagggacaggggagggtagcccccattctccaccagcattgtttcctggtcgtaccccaggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcaaggggtgggacgtgctggggacggggttccgaactgggcctgccctcggcccctcccaccagacgtgttcctctgcaggcggagagcagcccccagcgccgctcgctggtcctgaggctgtatgaggcccacggcagccacgtggactgctggctgcacttgtcgctgccggttcaggaggccatcctgtgagtggcggtgtgggattggggcgggggtcgagtctcgccctcgcagagccttcatggcccctcctgttctccagctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaccctgctgctcagtccccttagggcccatcctcacgcttggggtgggggtgggaagtctggggtgggatggctttcccaggtatttggtgggtaggggcaagatcctaaggtacctgtgcgtgcagggtctgggttgcagcccccacaggagagactggggacctcgagccaccaaaagccagtgaagagaccatgagttgagaagcccctcccctgtgccagcaggtaaagggcctgggcctggggctggggaggggccgaagggtgggttttgcctggctcctgccaggatgagggggcagccctggaccctggagaatctggactggaggagctctggctcctgggctgcctggggccagggtctttgtaccacctctgaggggctgtccttgcagaggcaaactgtcctctgatagagtcagagccttgaggactgggatgggggctcagtttgccttgtgaggagctgggccttctgtcaccaggaccggacagcaggcccttcctacctggccatctcagaccaagaggtgccaagaagttcaaatgtatcagtttattaaaaatgcagcatttttcacatgagctttaaagatgtggaagatggggtacaattaaaaccatgagagttgtgcagggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtggcctgggggaagaacaggcaagatggtcagctaagactccaggggctgccatggcagcctttctcccacctttgtacacgcgctcctaggccaccatcccatcctctcctgtagagccagtttctgggagtgatgaggaaagcccaccagaggctgcctgtcgccccttcctcctccccttcttgggcactgtgggagcttctgggtcctgctggaggctggtcccctcaggccgctgggttgcagtcctcttaggaaggtctctctttgcccttcgtgtcctggaaggggccttgcttggaggcaaagcgtcctggatggaggagacacgggtccctgaggggctcagaaagcagttcagaggttggttagggcccaccactccccccgccctcttagggtaaggcagctgcctgggaggggcagccagggctgcagagtgcaggggaggaggcgggagcaggcagccatacctccactctgtcctcaggactcagctgtgtggccttggatttctttttgcgggacttgcgccctgcaggacactggtgttggagttggagggtcctatcctgcccaggggtgactcccagggttgcagggggatagggtggagaagggtgctgtagcccttgcaggcgtgaagtcctttctgctctcttagcctattacattaggagtagcttacctttgggtgccaacggtccaggatccccctaaaatgggatggggataattcaggaatcagcctgggttggcacaggggcggtattccttggagaggcaggactcacacacacccatccagatcagtgtagcttctcccttaggaagcctctaggacatcccccatgttagagtccacatcagcaaagctgctctgcccttggctactttcacttgggctacctgccttgggctacttccactagctgcaaccctgggacgcatgggaggggaggggtgtgaccctcaggaacagtgtggtccttggagggtctagacagaccctgagcatcaccaccccagttattgtgaccccacgtttccacccatcagcctcctggggtctctgcctgtgtgaacagtagggcccaacctggaaccagatggtacggccatgccggtcctgcagggagctcatgcctggcatgccatagcagcgcagccagg

SEQ ID NO: 14402 - DNA, 87863 bp, Human
  misc_feature (1)...(87863): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggtaggcggggcgccggcgggaaccgtcccggccgggcggggcgacgccgggagaggcggcgcaggggcccagtccaccgagcgccgggcggcccttgcctgcactcctcggcccagactgtttactatctactccgccggcggcttgtgcaacccgcctgcaggggagctgaggggcggacccctttcctctctcccacccacctccggctctcccggaggccccgccttctcttgtcttccactggctaggcgagactccctttttttctccttcttggatgtggattggatgacattctcccgagctccgcctatcgggaggccgggctggagtttaagttgctaggattttttttttcgcggagggaggagggacggttcttgcggatgacgtgaggcgcaaggtcccgcccccgcctctgattggtggggcgggtagcccggcctcctccggcggagagagctgggaggggaagtccacccttgctccccgcctccctccgctcttgagcgcgctccgcacatgtgtgaggcccgcctagctccttcgaactgccctcccgcccggaagtcctaggctcggcgcccttggcgaggggggcggggagagccgagaagccacacaaaggttccaccgaggctcgagacctagtagccttcggggtgaagccaggggattacagtgcggagtggatttcgggagcgaaactccggaggttctgctgggtttgagatctgcctttcggggccggggccaagtactaaagttctaaccctgtcgcttggctatttccgtgccccttgacttccctgagcttaagctcgagaactctgcagacgctgcaagtgtctgttctttcctaggcatggcagcggctgtccttagttggctgtatctgagactctgacaacctagtgccctggcctggggcccttaggcgagatcttagcgcaggtggtaccctgtgttcacgggaagtcgtgggcggcctaatgctggcttgggttctgagtagttcttgataccatggtgggaatgccctgtggtactcagtctagtggtggaaggcggcgcaaagttaaaagtagccgtgggtcagttctgctggagtgccgcttcctcctaacctccgagcagtttggccctggggtcgcttcgttggtctgacttatttttagagctctgtcctggggcagggcttggctactggcgaggctgctcccacctgtcggctacccttggagttcacaattcgctgctgtggtttcgcggctcgaagccatcgctggagtcaggcccacctgctgccagagctcgttcctggccgtttccgctggattgcagagggaggacagtgttggacctaggcgtgggttccctgggcgtgtcccttggggtcttagctctctgggaggagggttctacttattcgggagagcggtaacaacgtaatcccgtcacctctcctggcgctgagagagcgccccccaaagtaagatcagcgtcaggcccacgccctatttggtgaataaataaaagcaaactaggaattgaaagcactttgtctcactgtgtgttcgaggcactgttacctacacagagagggcacaggaactgctattaacactcccggccaaggagaaggtgaacagccgttatcttatgtccccaactacggaaattttatccattctctgagtgtggcatgtccccaatgttaatttatgccgtggcctgttttggtgttttcctctcctttctcagttctgaggatgcctccagatccacccgggagatcgtgagtaccttgtgcctcacgctccgccttccggaggcttgccagggcggtggctgttagagcccgcctctcttttggttatctccgccctcttaggactgcatattcagctctagggagtttacttctccgcctaggtctccagaccttagttctgtactctacttggctgaaaggagttgccagctgctccggatatttgtgtttacaaggacgcagtgtgtagaatgtaaactgtaaagataactggacggaaggatgagttctcattctctcattttttttgtgagggagtcctccatggtgggctgcctttccttcaaatcctaggatgtggagtctccgctgatgagctccgctccccctcctatctcgggccctggaactccgagcttcagtctctagtgtaaacattccacaaaaggactgctaaggttcagcctcctcgcgcagggtggaattagctccttcctagacgggcgccctggccaatggagggtcctaccagcgccaagatatccaatccgactcttggggcggggcctggcccggcagtgcggtaggcggagcctgtttcacttacagacattttaccccacatcggttacttaccttactggggcggtgggagagccaggggtagccttccaatgcgatgaccagcggaggcgggagccaacttgttaggcctgtggctgagacgctgcagggcgggttatgtggtgtcctccaatgagacaggaagagcttccctgcttcctccaatagtgttggggctcgggggtgggcttcagcagtccgtctccaataggcggggttgagttagggaagctccccgccaataggggcgtggagaaggagagcggctccccctcccctaccagtcgagggggaaggggcgggaaaatcataagacaggcctcggtggttggctgagtctttgacgggcgggtattgcgtcctgtattggaacgaagctgagtcttccctctgcggggcggggtcgggggagtgggcgggatttcccgggtaacagagaagcggccgcggcggtagaggcggcggagacggtttctccatcttcccccctccccttcccccctcggagtttccctccctccctccctccctccttcccagtctgggcaccggagcctgtgaccgcttcgttagtggagaggtagctggcagtccgcttcggcgggcctgtgccccgcgccgttctcggggcctccctgctgagctcgcggctcacgctgagagggacacgcagtgacgagcggccgaagcagctttgcggtgagagcacgctgggccgggggccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttgcggccgaccaccccctcccctcctcctggggtgggcggggcctcgggctggcggccgcgctctggcctgctggggtcggggaggggtaggggggggtctcccgcgtgtagattcagggcgcggcagggagggggcagtgaaagtctgagttcctccgccttcttgggatccggttggccggaggggccgtactgatccgtgatgccactccccttggccgtccccccctgcaccccgcccaggccccgggtttccgcctccttggcaatgaggaggtgctagggaaagcccgctgtcgggtctggctgggagtctcggcgcctagatctgccccgccctatgtctccgtggggagggaggggcacccgccgactgggagctgtggaggtgtcaggacttactcttgtggctgggtcatgccttctgcctgggggcacaagggccctgtgctggagctgctttctccgctttgctccatgcagcgtgtctggcaccgtgcagccaggagagtgggagcatggtcacccccactcccctcttggttgtaactattggggcgaagtgcccaaggtcctcttgtaggagcgtgcgtggctggtgctggaaccctagatccgcggtggtgatggtaggggaggggcagggagtcatcagagactagaaatgtggcggagggaaaaccttccctggggttcccttgatgttcagttaccgtggctgtacggggcggggcttcctttgagccaatgggtggtgggtagtagacttggcgtctgtttcggtgcgttaggactttaaacgaagttagccttgaaaaggcagtggaagctcctcctctttacaaggctgagatttataacaggaaagtttggatttacattttaatctcaaaactggtctgtttataaagtagggtttgttttttttttttaagaactcagactttgaataaaatactccgatatctctgacagttgtatttttgaatgctttcattgtgcacatggttctgctatataaacttagtttcctggacgggcgcggtggctcatgcctgtaatcctagcactttgggaggccgaggcaggtggatcacttgaggtcaggagttcgagaccagccaggcttacatggcgaaaccctgtttctactaaaaatacaaaaaaaagctgggcgtggtggcaagcgcctgtaatcccagctactggggaggctgaggcaggagaatcacttgaacccgggaggcgagggtgcagtgagccgagatggtgccattgcactgtagcctgggcgacaggagcaaaactccgcctcaaaaaacaaccaaaaaaacttggtttcctaaagaatttgctatttaggtaactataggtgaaaagtacttttcttttttattttatgtacttatgttagaccatctagaccactttctatttatactctacatagtacagtgttgttgccctttttatttcagaggagggtggaattgtggatcagggtagccttctgtatgtgacttctgtagcgttgccctccagcctgtattggagagttgccttagggcatttcagatttagatagcagaaccacattagatgaggtttttgctttcacttgatacattatcttttcctattgagagaaattatttcaatgtttttcacatttttcatgagaaaaataaacatggaaccaatgtttatttatgcagtaatgtctaaatgagcctctggttaattatctgaagtgaaattctagatttgtgctttggttagtagggcctgagtggtaccctgtgctatatttatgtgaaaagggtaggtgggtcctaccttctctgctaaggaagttgcaaaagcaatagcattttagtttagcaaatgatggctgtaatagaattggtggggagacaaaaaatccaggtggttttttctgatgccataaactgagagagatagtggagaacgattgaccattgaggaaaatttgggctacatatatagttcccatgatttgcagtgctgtatactggggaacacagaagagtctataaggattcaagtaagaacctggttttgctgtattaggaacattttcataaatgcttcataatctccagataattattttatatactataattttgttcagagataaatagcttagaaagattggcacttcgtaattaagagggttttaataatttacatacagagaaagactttttttcttttttaaggaaggaggtgtgtagtaatttgacaagattcctggtgaagtataattctttttacatcttcagtgggagcagacaagacactggagagctgtgcatggcagatgttagtacctgggaattttaactggaattaagaggttatatccctggcattcagtagtttagcatagtgcttttcatggctttctctcttttctgggcaatccaccagccaagagtttgttaagctttactttctgtaggcctttaaaaaaataaatagtatatgctttttcaaaatacaccttcctcgccccttgaaaaataaaagctgatatttattgagcacttactgtgtcacagatactgtgttaggcactagacttttttttttttttgagatggagtcctgctctgtctcccaggctggagtgcagtggtgcaatctcagctcactgcaacttccgcctcccgggttctagcgattgtcctgcctcagcctccacgaagaagaagctggggcgccaccacacgcctggctaagttttgtacttttggtagaggcagggtttcaccatgttgatcaggttggtcgcagactcctgacctcgtgatccgcccgcctcagcctcccaaagtactgggattacaggcatgatccactgcacccggccgcataatgtctttttttctcatgtcttttttttttagacgaagtctcgctctgtcaccaggctggagtgcagtggcatgatcacagctcactgcagtgttgatcttctggacttaagcgaccctcctaccttagcctcccatgtagctgggactacaggtgtgtgccaccacgcacctggctaattttttttatatttttatagaggtgaagtcctgctgtgttgcccaggctggtctcgaactcctgggctcaagaggtccttctgcctcagcctctcaaaagtgctaggattaagacgtgagtcaccgtgcccggtcatgggtggcaatttctacctgatgtatttcttatttgccccttttgcttttgttttccctacccactttttgtcttgtatgcttgtatgttacccatatttctcagcatgacagtggacccttcatgagtcttcttggtgtcctccagggctaggcttgctgacatatgggctattggaggatatgcaggtccacatcctttatttgcagttctgaaatgcaagagtttttgttttttggtaagtctagttccacaactagttttggggtacagcctgacctgggctatcctgcatgatgcagaaatgtgactgcttgattatggggagctactcagccctagctgggagagagagatgatacagtatatgtaccatattacctttctaaaatccaaacaatgctgataactctaacggggatctctccctctaccatagactaatatgtttagtggcccactcaaggtctccactcgatgtctcctcttggataactaagagacattgttgactcttctgtgtctttttcatatgtggtccatcagtaaattttactgctttatattcaaaatactatccagaattagaccacttaggatctgcatctccactgccctagtcagtgcctgtgcatctctagcttggattctattctccttgttttgttactgcggctcttaaatgtgttctcaacatagcaacccaagtgattcttttgaaacctaagtcataccgtgtcacttctctgcttaaaaccatccagtggctttccatttcagtctgagtattaaacctgagtccttatttagatatgtctgtaatgagctgggcgcggtggcccatgcctgtaataccagcactttgggaggctgaggcaggcggatcacgaggtcaggagattgagaccatcctggctaacatggtctccactaaaaaaaatacaaaagagttagccgggcatggtggcacacgcacctgtagtcccagctactcgggaggttgaggcaggagaatggtgtgaacccgggaggtggagcttgcagtgagccaagatcgtgccactgcactctagcctgggcgacagagcgagactgtctcaaaagaaaaaaaaaaggatatgtctgtaatttcaccattttgggagctcaagtgggaggatcgtttgagtccaggagtttgagaccagcttgggcatcataacaagaccctgtctctataaaaaaattaaaaattagccaagcatgctggcgcgtgcctgtagtcccagttacttgagaggctgaggcaggaggattgcttgagctcaggagcttgaggctgcagtgagccatgactgtgccactgcaccccagccttgacgacaaaatgagaccctgtgtcaaaaaataaaaaaacacctgtaagaacaaatctgatgtaccctctgcctgccacccttatcctagtacctctctgactacatttctgactagtccttctttcgtttttcttcagctacccagccttcatgctgttttggaacatgtcaagcacatgtgagccctcacaaagacatgagggtctttgcggttgctgtcccctctgcctagaaggcttcctccactaatttctgcatgactagctccctcacttcctttactcagaagttaccttatcagtaggtattatctgaccattcttatctacaatttcaaaaactcttccttgccttttgttcttgatacctgtcactgcctactattctaaatattatactttgtctattgtgtcatctttcactaaaatataagcttcttgagggaagagatttttgtttaccgttgtatctccagctcctaaaacacctggtgcatagtatgtgctcagtagatattagagaatgtatacatgaatgaatgatttggtttccaccacagacaagacaaagcagtatgctgagcatggtagaggatacatagatggttaaagatgttatgtgcccatgtttgtgtgggagcagaagagctaatgtgataaaagcagtgtgagatgtgagtgacacttccacctgtcctttcaagaactatctcaagttctattctttgtaatgctctattttcttttctttctttcttttttttttttttttttcttttttttgagacaaggtctcactgtgttgcccaggctagagtgcagtggtactatctcggctcattgcacacacacacatacacacacccagcttcaagtgattctcctgcctcagcctcccgagcagctgggattacaggcatgcgccactacacccagctatttatttatttatttatttattttgagacggagttttgctctgtctcccaggctggagtgcagtggtgcaatctcggcttggcacaatctcagctcactgcaacctccacctcctgggttcaagtgattcttctgccttagcctcccgagtagctgggattacaggcacccaccaccatgcctggctaatttttttttttttttttttttttgagacagtgtctcgctctgtcgcccaggctggagtacagtagcgcgatctcagctcactgcaatctccccttcccaggttcaagcagttctcctgtctcagcctcctgagtagctgggatcacaggcgccaccaccatgcctggctaattttttgtatttttagtagagacagggttttaccacgttgaccagccttgtcttgaactcctggcctcaggcaatccacctgccttggcctcccgaagtgctgggattacaggcatgagccactgcacctggccttatagatattttgaaagattatatttcttatattaaatagagatagggtcttaccatgttgctcaggctggtcttcctggactcaagcaatccacctgcctcagacacccaaagtgctgagattacaggtgttagccaccatgcctggcctaatacttaatttttaaaaaactttttctttggaaataattttagacttcaaagagagttgcaaaaataatacaaataatagccctataatcttcacctagattccccaagtgcatcttttaaaaccacaatacagtgatcaaatcagaaaatcaacattgataacaattattaatacattttgaatttaactaaatttctgttcattttctacctacagtagtaagaaatgtctgggtaacatcagtgtcaccgaagtctgtattgcccagattggtctcaaactcctgggctcaagcagtctgcccacctcggcctcccaaagtgctgggattacaggcctgagccactgcacctggtctggactcaattttagtttttgagttttgctttttttttttaaagcagtactaactacttgtaaagatgtatatttcatgacttttatttattggaggtcttcaaaacagcaaagagaaaatttatttttatttttaattttatttttgagatgcggtcttgttccatccccaggctggagtgcagtagcgcgatcttggctcactgcaacctccgcctcctgggttcaactggttctcctgcctcaacctcccgagtagctgggattacaggtgtgtaccaccatacccagctaatttttgtatttttagtagaaatggggtttcaccatattggccaggctggcctcaaacttcttatctctcgaagtgctgcgattacaggcatgagtcaccatgcccagcctgaaaatttattttttttccaaaggaataaactcattttagctattaccacttgtacatcgaaacaatgttgtggagttttactgatcttatttttcctgtatattgaaatgttttggtatttcatcatcctaggaattatttcatcattactcatcaattctcaaatatgctaaagaggactaaaataatatgacaaagggagaattatagaattgcttaaaaggatatgcagtagtgaaataaatcattagttttacacttcagtttttagagatggggcctcgctttgttgcccaggccgaagggcagtggtatgatcatagctctctgcagcctcaaacttctgggctcaagtgatcatccctcctaagcatcctcggtagctgggactataggtgtgcaccgcagcccttcagttttcttattgcttttcccaaaacttacagcaactttttttttctttttggatacagggtctcactatgtcacccaggctggagtgcagtggcgcaatctcagttcactgcaaccttcgcctcccagactcaagcaatctcacctcagccctccaagtagctgggactacaggcatgtgccaccacacctggctaatttttgtattttttttgtagagagaacgtttcgccatgttgtctaggctagtctcgaactcctgggctcaaacaatccacccaccttagcctcccaaagtgctgggaattccaggcatgagccagcatgcccagcctacagcatctttcaagaaaagtataaaagaagttgggagataccatcttaaacattatgtaagatgttaacatttggagaatctaggtgaaggagtacatggtaatttttatactatttttcaacttttaagctttcattggacatatttaaaaatccatagtttttcatcttcctcctataatggcaaagagaagaaaactgactacagaagacatttcagaggaactagtagatgaatgctgtgtgacagtagtactctagactgttaggatgacggtaaagttatataaaccaagttgtaaaataagagtcttcagccaggcatggtggcgtgcacctgtaatcctagcatctcgggaggctgagatgggaggatcacttgagcccagtacttcaaaaccaggctgggcaacatagcaagattctgtctccacccatatacatatgtgactgtaccctagatgagtttagaatgtgattttttttttttttttttttttgagacagagttttgctcttattgcccaggctagagtgccatggcacaatctcggctcaccgcaacctccgcctcctgggttcaagggattctcctgccttagcctcccaagtagctgggattacaggcatgtaccaccatgcctggctaattttttgtatttttagtaaaagatggggtttctccatgttggtcaggctggtcttgaactcccaacctcaggtgatccacctgccttggcctcccaaagtgctgggattacagtcgtgagccaccatgcccagcggtgaatttttttttttttttttttttttttaaagatgggatctatctcactatgttgcccaggctggatttaaattcctgagctcaagctgttctcctgcttcagttcccccaagtaactggcactataggcatccagctagaatgtgattttctttttataagaatcagaactgggctgggtgcagtggcatatgcctgcaatcccaccttcttgggaggctgaggtgggaggatcgcttgagcccagacgttcgagaccagcctgggcaacatagtgagaccccatttctatttttaagaaatgaaaaaaaaaaacaatcaaaaccactgcactttgccaaaaagatgtatgatagtattctttcatctttcaagatatttgtacaccaaaacttagttgatgcagtttgtaagtggacaggtgccaaagttacgtatatgtataaagatggttagaaggaaaaattatgtaaaaatgaaaaaaaaaatcaggtttttttttttttttttttttttttttttttttgagacagagtctcactcttgttacccaggctggagtgcagtggcatggtctttgctcactgcaacctctgcctcctgggttcaagcgattctcctgcctcagcctcccgagtagctgggactacgggtgcgtgccactgcacccagctaattttttgtagttttggtacagatggggtttcaccgttttagccaggatggtctcaatctcctgacctcgtgatccacccgcctcggcctctgagagtgctgggattagaggcaagagccacacgctcagcctggattgttcattctgattgacatttattagtctaaaaatgagaatgcttatgattatggagcaaagaagatgactgttctctccaacaaaattatgaagtgagttttcaaagtatttcatttgatgggcagaaagggaaaaaaagacccagaggtgataagctagaaccttactagagctgtacctgaaacctggaatcaaaatttacaaaatggaagccaagcgtggtggtgtgtacctgtttacagagtggaagccaagtgtagtggtatacaccagctactcgggaggctgaggccaggaggatcgcttgtggccaggagttcaagaccggcctgtgcaatgtagggagaccctgtctctaaaaaaaatttttttcttattagccactctgtagtcccagctacttaggaagctgaggtgggaggattgtttgagcccagcagtctgtaatgagctatgatcatgccactgtactctagcctgggcaatagagcaagaccctgttttttttttattttgttttttgtttttttgagacggagtctggctctgttgcccacgctggagtgtagtggcgagatctcggtcaacctccacctcccaagttcaagcaattctactgactcagcttcctgagtagctgggattataggcacacgccaccatgcccggctaatttttttgtatttttagtagagatggggtttcaccatgttggctaggctggtcttgagctcctcacctcacgtgatctacccgacttggcctcccaaagtactgagattacaggcgtgagccactgcacctggccaaccctgtttctttttcttgttcttttttttttttttttttttgagacagagtcttcgctctgtcacccaggctggagtgcagtggcgcgatctcagctcactgcaagctctgccttccaggttcacgccattctcctgcctcagcctcccgagcagctgggactacaggcgcctgccaccacgcctggctaattttttgtatttttggtaaagacggggcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaggtcaggagatcgagaccatcctggctaacacagtgaaaccccatctctactaaaaaatacaaaaaaaaaattagccaggcgtggtggcaggcgcctgtagtcccagttacttgggaggctgaggccgaagaatggcatgaacctgggaggcggagcttgcagtgagccaagatcacgccactgcgctccagcctgggtgacagagcaagactctgtctcaaaaaaaaaaaaaagatatgtgacagttggggttatgattaaacttaggtttctcagtcttcacacactgttgacattttgggccaaataatttgttgtgaggagactgtcgtgtgcattgtaggatgtttgacaacatccttttactctatctgtgagatatcagtagcattccatcttcccgagttgtgacaaccaaaaatgtcttccatcattactacatgtgcccttgggaggcagaatctcccctagttgaggaccactgcattagaagaatataaaaactgagttcaaaggaggcttggatattagatctaatggtgtcttttgagaagagctggttgttaatttttccaagcaataattctaatcaatatatgaaatctaaatagagtgcctttcattctgtaatagattctttcttagcagatttaaaaccagaggtggacttttggacaaattttgaattagactactcaaaattgcactgggttgaagtttacattgacttaatactgcgatggaagtttgcttttgaagagaaactttccattgtttcaagaatatgcatttaaaaataagcaaaaaagagtatgcatttatttattttattttttgttctaagagtatgcatttaaacaaactgaccaggatagacttttgtttttttgagacagggtcttattccatcacccatgctggagtgcagtggcataatcacagctcactgtagcctcaacctcccaggctcaaatgatcctcccacctcagcctcctaagcagcaaggactacaggtgctcactaccatgcccagctaatttttaataaaatttttttgtagagacggtgtctcactttgttgcccaggctcatctcaaactcctggcctcaagcaatcctcccaccacggcctcccaaagtgctaggattacaaatgtgagctgctacacccagcatcccacccgtttttttttgtttgttttgttttttgagacggagagccttgttctgtcaaccaggctggaatgcggtggcgcgatctcagctcactgcaccctccgcaccctgggttcaagcgattcttgtgtctcagcttcctgagtagctgggattacaggcacccacaaccacacccggctaatttgtttttcgtgctttagtaaagacagagtttcgccatgttggccaggctggttttgaactcctgacctcaagtgatccgcctgcctcagcctcccacagtgctaggattacaggtgtgaaccaccgcgcccagttttattataacacatggccaggtgacttttaggacctgtaggtgttttttttgtatgtgtgtatttgggatcttcctctgtcgctcaggctggagtgcagtggtgcaatcttgcttaatctaacctccacctcctggcctcaaatgatccttcctcctcagtcacccagagtgctggaattacaggtgcaagccactgtgcccaccaggtgacctttaaatgttctgctgccattatttagtcttctctccatagtttctatacgtcaaagtgctttttttttctttttataatgtcttcctagactagagttctgatagtactataaactccaaatttgaaacagatggagatcaaccatgttggctgaagcgggacttgacagtacttttgtggctgactttgtggttccatcgtttggctttctttatattctagaattacactgtacccctctgcaagcgtggttttacagtcttgtccaatgtttctactttagattgttcatattccaaggaggaagaatttaacctcttgctcttttagtcaggtatgtgaccttgaataagtcatttaatttgagtatcagtttccctcaaaaaaagaggggtctggctgggcgcagtggctcatgcctataatctcagcactttgggaggccaagacaggaggattgtttgaggccaggagttggagaccagcctgggcagcatatcgagaccctgtctctacaaaaaatacaaaagttagatatggtggcgctgcctatgtcccagctacttgggaggctgaggtgggaggattacttgagcccaggaggttggggatgcggtgagccgtgatagccctgctgcactccagcctggtggacataatggtatgctattgcaaaaaaaaaaaaaagggttctgggactgcctatctgacaggattgttgcgaggaggacatcagctgatagcagtcatacatggaagacttggctgttgtcggggaggaaatctctggctcagtgctggacttctaaccctccgcacagggccaggcatgtcttaagcacttgctaattatttgtgggatgaatgacttggcaaagattgtaaataactattgcctgcaagtctaaacttactattttaatttcatgctctatacccctgtgttctaattcatctctaattttcaagatgtagctgaatatttacctttatagagtcttcccaagtgtacctgtctgtatccctttcccaatttatagtacttattttttccactcaagagctggtttgtattgttggcttttcttcctgtttttttttttcctaatcctcagaacctgtggatgtttttttccaagactttatcaagaaaatttccaaatacacaacaaagttgatagaattttagtaaatataatgaacacccatatacacactacctagattttaccattatcatttttctactactaggtttaacatatgcctgtccatctatccatcgctccatcaatgaatctgattttttgatgtatttcaaaataaattgcagacattagtatacttcatctaagcacttgagcatgtttatcattatctagagtttaatattgtttatagcatttttcttttttgtccaggctcgagtgcagtagcgagatctcagctcacctcagcctctgtctcctggactcacatgatcctcccacgtcagcctcctaaatagctgggattacaggtacatgccaccatgcatggctaattttgtattttttgtagagatggagtctcgccatgttgcccaggctggtcttgaactcctgtgctcaagaggtccgcctgcctcggcctcccaaagtgctgggattacaggcactttgtgagccattgtgcctggctagcatgttttttctttgtctttttcttttttgttttttttgtttttttttttgagacagagtctcactctgttgcccaggccggagtgcagtgacgttatcactgctcactacaaccttgcagcctcaacttctgaggtcaagagatccttccacttcagtcactggagtagctagtaccatagttgtgcgccaccacttccagctaattgtttctttattttgtagagacagggtcatcccattgttgcccaggctggtctccagctcctgggctcaagccatccttgagcctcagcttcccaaagtgttgggattacaggcatgaatcactgtgcccaggcacatttttctttcaatgcaaattttacatacaatgaaatgtacaaatctttagtacattttgtatgtgtatatatacatacatgagatcatgctgtatgtattctatagcttactgttttcttcttctttttttttttttttttgagacgtagtttcactcttgttgcccaggctggagtgcagtggcgccatcttggctcacctcaacctctacctcctgggttcgagtgattctcctgcctcagcctcctgagtaactgggattacaggcatgcgccaccacgcccagctaatatttgtgtttttagtagagacagggtttctccatgttggtcaggttggtctcgaactcccaaactcaggtgatccacccgcctcggcctcccagagtgctgggattataagcgtaagccactgcatccggcctagcctgctgttttcacttaatatgtcttagagttcattctttgtacttgtggataaaccctgatctttctgattcctacatagttttccataatatgcatgatcacatttatttagctgatagatatttagattttcatattttgctgcaataaatatactcagcagatgtgtaggatacaggcctgaaagtggaattgatagtttcagtattccaaaatctagtatgttttagagttcatttcttatactcgtggataaactttgatctgattcttacatagttttccataatatgcatgggatgggtatgcacatttaaaattttaataaatacctacaagttgccagctaaataggctgtaccaattaaagcctcctccatcagtgtttccctgtatccttacccacactgtcatcttttttttttttaaattgctttggagtaaattacttttttttttcttgaggcggagttttgctcttgttgcccaggctggagtgcagtggcgcgatctcggctcactgcagcctctgcctcccaggttcaagcgattttcctgcctcagcctctcgagtagctgggattacaggcatgcaccaccatgcccggctaattttgtgtttttagtagagacagagtttctccatgttgatcaggctggtctcaaactcccgacgtcaggtgatccactcgcctcggcgaaccaaagtgttaggattgcaagtgtgagccacggcgcctgaccttttattttttttttttttgagacagttccactctattgcccaggctggagtgcagtggcgcgatttcggctcactgcaacctccacctcccaggttcaagtgattctcgtgcctcagcctcctgagtagctgggattacaggcgcccacaaccacacccggctaatttttgtatttttagtagagggagggtttcaccatgttggccggtctggtcttgaactcctgacctcaagtgatccgcctgcctcggcctcccaaagcgctgggattacaggcatgagccaccgcgcccggcctactttacacgttttttattactagtgaggctatatatggttttagagggcaagggctgaaatcatctaccaacttcatatctactcactgaacatttgcttttaatgaatgaatgctactaaagcatttctgctttattaggtttaggctgaagaaggatgagttagctaagtgtgtgaaaggttaaaaaaagctgaacttgctaccctgcatgtgtgccttaaataagtannnnnnnnnnnnnnnnnnnnnnnnnnnnnnnnnnnnnnnnnnnnnnnnnnnnnnnnnnnnnnnnnnnnnnnnnnnnnnnnnnnnnnatcacagctttgcctcttactagctgtgcaaccttgggcagtttacttaatctttgtttttcagtttcctcattcataaattagagaacaccttgcttataaggttgttgtgaaggatgatcagggcctgaaaccaggaggtatgattagagcggaagcaatttatttgagagagagttaggaatagaactttgagtggtaattgtttgtttgtttgtttgttgttgttgtttttgagatggagtcttgctctgtcgcccaggctggagtgcagtggcatgatctcggctcactgcaagctctgcctcccggtccacgccattctcctgcctcagcctcccgagtagctaggactacaggtgcccgccactacgcctggctaattttttgtatttttagtagagacggggtttcaccatgttagccaggatggtctcgatctcctgatctcgtgagccaccacgcccggcctatgagtggtaattgttaaaggaataaagtatggttcagagaaagttcagcctctgtagtgttgtagaggtggtatggaaagcaaactctggaggtggatgaagttaagtaccatatgaaatcccaatcacttaataaaagaaacgatattttaacagccaaaagatagagtatgatatcagaataaaccatagtactgtaatacttaatgtatgaaaagctcactacaatcttctttttccttatagactggttcataaaccagcatttggaaatcactaatgtaggctgatcccctccttttgcccctgtttgaaaacagggccaaaattagaaagcttcatggtagatagagtttggagtagaatccagttcttttttgtttgtttttattttttgccctcaaacattctcccatccaacagaatccagttcttaaaaggtactctagtgttttttctatagtcgtgccgtgctcttcacatctgattttggcttattatttataaagtttttttttgttgttgttattttttgagacagtcgcgctgtcccccagcctggggtgcagtggtgcgaatttgctcactgcaacctccgcctcccaggttcaagcgattctcccgtctcagcgtcccaagtagctgggattacagatgcgtgccatcatgcccagctaattttgtatttttagtagagactgggtttcaccatgttggcctggctggtctcgaactcctgacttcaggtgatccacccacctcggccttccaaagtgctgggattacgggtgtgagccactgtgaccagcctatgaagtttttgttttttaaacccagtgctgccctatcataacatttctataattttttttttttttttttttttgagacagagtctcagtctgttgcccaggctggagtgcagtggtgggacctcccctcatgcaacctctgcctcctggattctagcgattctcatgcctcagcctcccaagtagcaggttttacaggtgtgcgccatcacacctggctaatttttgtatttttactggagacagggtttcaccatgttggccaggctggtcccaaactcccgaccttaggtgatctgcctgcctcagcctcccaaagtgctgggattacaggtgtgagccactgcatccggccaataaagtattgacttcatttttggttacagaggttaatctccgatgagttaagcatcagttttaaaccaacagaacccaagaccaaaccactgaaagtcatgaacgtatataagaaatagctaaaaagacattttactctacctgtgattagactcagttcctcatcccaaaacacgctgaggtttagtgttcgtagttgattagtggcaaataacatgcataaatctatatactcaacctcttaatatgtctaaaaggtttttgaatactaagctaaacatgctatttcatgctagaaaaacataggaaagcataactagctaagacattttaaattatttgtcctcagcagctgtcagaaacgttctcaactccatttaactgagttccacatattatcacacacaaagctgagagacttagtctgaagttatataggccacagagagcatatttgtggcttgagtttacaaatagataaaagtagccagcttgcaaattaatgggttgtgctgctgtgtcagggtcccacttaggtatgtgaaatgtgagaaaaacctgagacaggatttcagagctaaggattagagtggcaggcagattgaggactatagtgaggacaaagaaaaggtgaaacagccatggagagtccttgtaaagactactttcccttcagggcttgtgtgctcccagaggataaagaaaagatcttgggtagacttatgaattaggtaaagattttttttttttttaacttaaccgtatttcagatgagggggtggcttgccaaatctcccactattactgtaaattttatcttctttccatagcagtggtatcttatttaagagatttttttgggactggaaaagtggtggggccttttttctttggatggctgattcattctttctcactgatggtgtgttatgcttgtgttagtgatactgatatggaaaagctctgaagacccaagtagattactgggccaagtagattactgtgtcctgcaggaatgaaattgtctcccacggaggtattattaagctaagagaatctcttcttataactgttaaaaccagaagaaaatttaggagtgatctgttccaacttttcttattttatagttggagaaactgaaattcacatagaatgaggaacttgttgaagttacgtagcatcttaaattggcaagtctagaatctttgtcttcccattcctggcacggtattctttccatgataccattataattgttgaaacaaattttaaattagaccacaattatagtagtaggttttgagaggatttaagaagaagcacttgaggccgggcgcggtggctcacgcctgtaatcccagcactttgggaggctgaggcggatggatcacaaggtcaggagatcgagaccatcctggctaacacggtgaaaccccgtctctactaagaatgcaaaaaaagtagccgggtgtggtggcgggtgcctgtagtcccagctactcgggaggctgaggcaggagaatggcgtgaacccgggaggtggatcttgcagtgagccgagatggcaccactgcactcagcctgggcaacagagtgagactccgtctcaaaaaaaaaaagaagaagcacttgaatatttttgcagcatgtagatatgtaattaatattaggagtgatagcatttgaggagaaaactagagaataaagggaaacaaggttgtgtttatatttttaaattggagcgtatttttcaacttcataataccaaattaattaaaattatgttatttaaatatttgtctttttcagttataacttgttcactgtgttggggggtggtatgccccacatgcacttaaacttcatcactaagatgaaatagatgatcagttctgggagtcaagcttttactaaacttgggtgactggtcctaagtggcgtacatcatactggagtgagaattgacttgcatgctattgcttttggtttctgcaggttttgtagtgcatccctgagcatgagcacagaatgaaccggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtaagctggagccaaccaagggactagaatgagggaagagaaatagtggttttaggcaattataaaactttttttaatactgtgttagatattaaaaattgttgagtatgtgtaaggtaaaaaaaaaaataactgtgtactcaccatacaagtttttaaaaaaagaatgttgtcatgacctttgaagttccctgcgtatcccactctgctcccttcttttccctcccttcagaggtagccactgatctaaactttgtatttatcattcccttgactttatttacttaaaaaaactaacataattgtttagtttcggtatttttgaacttttatataaatggaaacattttcttctttgactcactttgttttaaaaaccccatatttttatagatcgctgtaattccaccattttcactgtagtgtaaattacatgcatatactcaatttatttgtcaattctactgttggactattgggctgtttccaggtttttgcttttacaaaggtgctgctgtgaacattgtgatattgtcttagtgcactcagtggcaattcatgacaaaataagaagcttgtgccagaatttaaatcaacgcacttattaagacagttttgctatttatttttaaaaaagacagctgaattaaacatcattgtagtgaaatatggctgactcttggacagtgtgggggttgaggcactgacttccccccatgcagtcaaaaatacatgtataacttttttcctttttctttttttaggagatagtgtcttgctctgtggcccctgttggggtgtagtggtgcgatcatgactcactgcagcctcaaactcttgggctcaagcagtcctcccgtgccctagcctccctagtagctaggactacaggtgcacaccaccatgcctggctaatttttatgatttttgtagagatgaggtgttgctgtgttgctcaggctggtcctaaactcttggcccaaagctatcctccccccgccagcctcccaaagagctgggattacaagtctgagccactgcgtctggccaatgtataatttttgactcccctaaaacttaaatacaaatagcctattgtccagaagctttaccgataacataaatggttgattagcatgtattttgtatatttgtcatatactatattcttaaaataatctagaagaaacaaaatactaagaaaatcataaggaagagaaaatatatctaccatttattaagtggaagtggatcatcataaaggtcttcatccttgtcttcacattgaggaggctgaggaggagggagaaagaagatgaagggttagtctggccatctcagggttggcagaggtgggagaaaatccatgtataagtggacttgtgttgttgctgagtgcagtggctcgcacccataatcccaacagttggcgaagttggaagcatgaggattgcctgagcccaggagtttgagatcagcctgggcaacatagcaagccccgtctctcctaaaaataaagattagcagggcgtaatggtgcacacttgtgttcctagctacttgggaggctgaggtgagaggatcatttgagcctgggaggttgaggctccagtgaatatgcttccgcacccagcgtgggtgacagagtgtgaacttgtctcaaaaagaaagaattaattaattaatttgaaaaaataaataaaaaattagccaggcatagtggtgtgcatctgtagtcctagctacccgggagactgaggtgagaggattgctcaagcccaggaagtcaaggctgcagtgagctgtgatcaagcaactgtacttcagactggacaacagtgcaagaccctgtctccttaaaaacaaaacaaaaacccgtgttattcaagggtctaccatcgttggtttacattgtggtgcaaactccttaacctgttggaaaccagtcagcaggtttgaggacatacaagagtttgtcaagtacctatgaaagggattgctgtgtcacagggtatatgcatctttagcaagttcccccaagcattgtatattcctgttctatgtcctgaccaacactgatcattcatctgttactctgttttgtagaagtgaagaaatttggtttttgcccttttttattatgaaagtaatgtatcactttggtttttttattttttattttattcatttatttatttatttatttatttattttgagatggagtttcgctcttatcacccaggctggagtgcagtggtgcgatctcggcccactgcaacctctgcctcccgggctcaagtgattctcctgcctcagcctcccgagtagctgggattacgtgcacctgctgccatgcctggctaattttttgtgtttttagtagagatggggtttcgccatgtgggccagactggtctcgaactcctgacctcaggtgatctgcccctcttggccttccaaagtaccgggattacaggtgtgagccaccacgcctagcctattttatttatttatttatttatttttgagacagactctctgtctgttgcccaggctggagtgcaatggttcagtcttggctcagtgcagcctctgccttctaggttgaagcgattctcttgcctcagcctcccgagtagctgggattacaggcgtgcaccaccacgcccagctaatttttgtatttttagtggagatggggtttcgctgtgctggccaggctggtcttgacctcaggtgatccgcctgtctgccttccaaagtgctgggattacaggcgtgagccactgcacccggccttattttatttttttgagatggtgtctcgctctgtcgccccagctggagtgcagtggcgtgatcttggctcactgcaacctctggcttccaggttcaagtgattctcatgccccagcctcttgagtcgctgggattacaggcgcaagccaccatgcccggctaatttttgtatttttagtagagacagggttttgccatgttgggcaggctggtcttaaactcctggttttaagtgatctgcctgccttgacctcccaaagtgctgggattacaggtgtgagccactgcaccctgccacactttgatttttttttaaaaaaaggatataaaatgactttttttctgtcacacctcagattttctcccactggtgaatttcttgggtatccagttttatatgcatatacaagctcatctatatcaacctgtctagctatctaaatttacttttttttttgagacagagtcacactctcgcccaggctggaaggctgtggcatgatctcagctcactgcacccttcacctcctgggctcaagcaatcctagcacctcagtctcccaagtagttgggactacaggtgcatgccaccacacctggctaatttttgtattttttctatagagacagagtttcaccatgtttcccaggctggtcttgaactcttggactcaagtgatctgcccgactcggcctcccaaactgctaggattacaggcatgagccacctcgtccgccctttctgcttttctttttgtacaatgtggatcatacattacatactattgtgctgtttgctcttttcatttaatatatagtggatatctttctacttcagcatataactggtctggggaggccttcaacctcatttgttagtgaccttaaaaatgtacggctggtaatgggaatataaactgacgtaatcttttttgagagcaatttggcagtttgtgtcagatggttttgttagtttttgacctggcaattccatttctaggaatttagtataaaaatataaagaagaggaaatgcagctgaagtaggaaatggtgattacttaggtgtcactcttcctcaggagtccccttgaggctgtctaatcccttcctgtggggctggggcagcagtcagaagactgccaacagatggcatcttttaggacttggaagaaaaaaaagttgcttgtttaccttgggtgattactttcattatctaaacaggttaatgactgttttctacatttgggatagttaaatttcttccgaatggaaactataatgtgtttgtataagtcagtctagtgaaagcctgtaaaccctgtaaaaaacatgcatgttggaatacagaagctcagaatactagcccatctttgaggtacattagagcttttagaattgtctaaatagtttctttttactcttaatacaccttgttttgtttctgtggatttatgcatagttgcttggtttctccctctccctcatttcttcatctccctccaggataatttttataaaagtgaggatttgaaaaaaagttttattctctcttaaattgtggtataaaacttaacattgtttagagaaagaaagtttcatgttatttagtctccttattttggggatggggcatttgggcatttggacagattgttgtcttctgtggtgatcaacaattctgaaaaaggaaaaaagttctgaaaaaaattttgtagcatttcttgaaatagatatagaaggaaagtagttttggcttttatttcctcaaacttgtaagaggacaggagaaagactgagataaaagaatagaaaagacatttgtttgaggccaaaccatcaagaattagggggaaaaaatttattttacattagatacagtgctcgtagcaaatcaagataagcaaaataagccaagtaggccaggcgcggtggctcacacctgtaatcccagcactttgggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatataattttttttcttctttttggagacagagtcttgctctgttttctaggctggaatgcagtggcatgatctcagctcactgcaacctccacctcccaggttcaagtgattaccgtgcctcagcctctcagtagctgggattacagatgcgtgttaccacgtccagctattttttttggtattttcagtagagacagggtcttaccatgttggccaggctggtctcaagctcctgaactcaagtgatctgtctgcctgggcctcccaaagtgctggttacaggtgtgagacactgttcccagctaaactatatatatatttttttgtttgtttgtttttgagatggagtcttgctttgtcgtgcaggctggattgcagtggcacgatcttggctcactgcaagctccgcctcctgggttcacgctattctcctgcctcagcctcccgagtagctgggactataggtgcccgccaacacgcctggttaattttttgtatttttagtagagacggggtttcaccatgctagccaggatggtctcgatctcctgacctcgtgatccgcctgcattggcctctcaaagtgctgggattacaggcatgagccaccgtgcccggctatataatttttaatagctacaaataattttgttataactttggtgggctgtaatttatttaaccagttccttttgtggaaaatttgggtttctttctttttcttttctttctttttttttagagacggtctcattctgtcacctgggctagagagcagtggtgtgatcacagctcactgcagccttgaactcctggactcaagcaatcctcctcctttagcctctggagtaggtgggaccacaggtgcatgttgccatgcctggccaagtttttattttttgtggagatgggtgtcactatgttgcccaggctttcttttctctttttagagacgtggtctcactctgtggcccaagctggaatgcagtggcatgatcatagctcactgcagccttgaactcctgagttcaggcgatcttcctatgtaggtgagataggtgtgagccatcacgcccagcagaaatttgggtttccaattaattatctttgtgcatttgtgttagttatttagactcatttggggaagaatgtacaagccttgaagtttcctgtctgtattttgttcaccccaggtttcagccatgccacagagctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggtattcagctctttttcttgggtcaaaaaatttatctttagcaggaaatactggttgcagcttgttggttgtggtggtacaacttctaacctgagatactagctgtcgaatcacaagttttaccgtttttgttttgtgaaatttgcttatgtttcctatcttggcatcagtgcctgatccagagaagaatatactcaaatgtttgtggactgtatgaatgcatgtcggtcaaatgttatcaggattgtggggccattttaatacaaaataaaccttaaaattcattttttggctgcttccttttgaactctctattgagcacatatatgattggctacaggttagtacagtaaattggcccagtaatatatcttacagttcaatctttttaaattcttaaaaatttttttttttagtttttagtttcagagatgggagtctcactgtgttccccaggctggtctcaaactgctggcctcaagtgattctcccatcttggccttcgaaagtgttgggattacaggtgcgagccactatgcccagctcatgcctgtaatgttcttattacctttatctttttattcctgtttatgaatagctgaattgactcacatcatcaagtccattcttagtaaaacacatgctcctttttggggggaatctttataaagttcagggaaaactgtaactgtgaatgaattatcagtgttttcatattttctgctgagtatgtgtggtacgttttcagtgctttgaaattcatgaggcatccctggagaagtgaagcttgtgttcccagctaaccttgtatctctgaccacttgaatgttacttttcaaaatatgtgattgttgcagcaagtgttcaggtttcaatttttctaattttacgtttatataaaattaagttcaggaaataataaatggaggaactctgaagagatgttaaatcttcatttggttattgcaacctacttatgttgcttgcaggcacgaatgagaaataaaccctctaaggacatatccatatgcagcaaatagttgtttcttctgttttccctgatacttactttagttcttcttgatccctgccctcgttggtgtggattcttgggaacttgtttaatattggcctaagagtattaaatgctacataaatattataaagtacagcaaagctatgtgatttagagtaattttgtaaaatttactctctatattggcttacatagtattgactaatgcatagccttttaaagagagtacaggttttttaggcctgaagcttcactctggattctgtctttgggaaaatgtgtataaggaatattgatgtttcctttaaaacattttcagtctgttgtagagtgatggctgtgtaccaaaatgtattattgctgcgggcttagcactttactaagtcctgaaaatattttttttaaaacttggttgtgcgtgatttaattctgtattaacactgtatattcagtagttatactttaatgttgcaaaatagcttataaacttgcttattaaactaacaaaaacatatgtatttctatagcctttttcaatcaaccctatcaaagcacaacaccagtttttacccaccttcctcacaggactctttggtataagtatatggattatgttttgtttgctttatggaaactggcaaggaaacaaggaaaggttttggatttggggttatagagtgagtcatagatagagttaggatttcttgttgtgttcttttagtcacaagctcttgactatattcctgcataaaataacttgttgaatttcctttctgatgaggagaggtaaaatgcttcttgtacctccatgtaatttaactcagtattcccacattgcctgtcatttttggatcagtcttaaaatgcattacaagcatttgaatcaacttcaataaatcatttatattctataataatgtaggccgggcatggtggcttacacctgtaatcccagcactttgggaggccgaggtgggtggatcacctgaggtcaggagttcaagaccagcctgaccaatgtgatgaaaccatgcctctactaaaaatacaaaatgagccaggcatggtggcgcatgcctgtaataatcccagctactcaggaggctgaggcaggagaatcgttggaacccaggaggcagagattgcagtaagccaagatcataccactgcactcgagtctgggcgacaagagtgaaactccgtctcagaaaaaacaaacaaaaaaaaagaaatgttcagtgagaatgcttacacattatttcaagcctcaacattgtcttttttttttgttttttgtctttggtagattggtggtgacaagaagggatttgaacgatttgaggcatgtttggtgttatttagttattgaatgtcagcagcagtgatatttggtacatatttagcaggttatctttacagttgcttgtgtttttctctcccaacaagattgtagacttcaggagattcagggccttaatagtaaatccctgttgaagtgagctaagaaactttatcagcagagtctaagggtctccccaagtgcttccttaaatctgtagcttctaaataactacatccaagttttttttttaagttgtgctacctagaactgtatacatgcatttatagagagtttatataagagttggactatgctttaggtgatgagagaatttcctcactatttttacatgtaggtgtcttatttattatgtgagtgtcatgcagagtttttaaagcataggattattctataacttttattttacttttttgtttttttgagacagagtctcactctgctgcccaggctgtagtgcagtggcgccatctcaactcactgcaccctcccctgcctgggttcaagtgattcttatgcctcagtctcccaaatagctgggattacaggcatgcaccaccaagcctaatttttgtatttttttttttttttactaggacggggtttttccatgttagccaggctgctctcaaactcctggcctcaagggatccaccctccttggcctcccagagtactaggattacaggcatgagccaccacaccctggcctataactaatttttaaacagtggtttgcttggtttgctgtgactttcagtacctttttgtttcagacatatacatatcacacataattgctttcttttgggtttctgtactttttccgtctctgcagtagttaccttataccataccatgtcttattgataactgttcttttgttgtgtaatgatgcatgctattcttaaatatcttccaaagtcttggttccttttgcaaacttaatatattttgtgttcacttaagttggtcattaatgaaacattttagtatggaaagttcagaatatgaattaaaatagtccattgaatttcaacagaaattgtcatgatatttgtatagaaaaactaaccatcaaacaagtgggtattgaccaactatacaatctgatttctagcaacaccgaaacactgattaaccatggccgtaatggaagtctgaagaactcttaaacagccatttgtctcggggccgggtgcggtggctcacgcctgtaatcctagcactttaagaggccgaggcgggcagatcacgaggtcaggagatcgagaccatcctggctaacacagtgaaatcccgtctctactaaaaatagaaaaaaaaattagccggccgtggtggcgggcgcctgtagtcccagctacttgggaggctgaggcaggagaatggcgtgaacccgggaggcagagcttgcggtgagccgggaaagcgccactgcactccagcctgggcgatagagcgagactctgtctcaaaaaaaacaaaaacaaaaaagcggccatttgtctcaatccattagtgctgctataacaaaatacctgagactgtataatctaaataatagcagtttatttctcacagttctggagaagttctgggggctgggaaatctaaaatcaaggtgctggccgggtgcggtggctcacgcctataatcccagcactttgggaggctgaggagggcagatcatttgaagtcaggagttcaagaccagcctggccaacatggtaaaactaccgaagatacaaaaaaatgagccaggcatgatggcatgcacctgtaatcccagttactctggaggctgaggcacgagaatcgcttgaactcaggaggtggaagttgcagtgagccgaatttgtgccactgcactccagcctgggtgacagagtgagaccatgtctcaaaataaataaataggccagacgcagtggcttacgcctgtaatcccagcacgttgggaggccgaggcgggcggatcacgaggtcaggagattgagaccagcctggccaacatggtgacaccccatctctactaaaaatacaaaaattagctgggcgtggtggcaggcgcctataatcccagttactcaagaggctgaggcaggagaatcgcttgaacccgggaggcggaggttgtattgagctgagatcgtgcctttgcactccagcctgggagacaagagcaagacttcatctaaaaaaataataataataataaataaaataaataataaaataaaatccaggtgccagttggtttggtgtctggtgagggcctgaactctgtttttcgagatggtccctgaatgtgtgtccttacactggaagggagaagggccgaagggactaacactggttcactccagcccttttataaggtccctaatcccattcatgagggctccacaatcactttctgaaggcctcacttcttaatatcatcatatcggtgattaagtttcgatgtaagaattttgtgggacacatttcagaccacagcaccagttaatgattgacttgaatgtaaatgttccattttgcaacaaatcaaaagactatctatgcctggccaggtgtggtggctcacatctgtaatcccagcacattgggaggctgaggcaggcggatcagttgaggtcaggagttcaagaccagcctggccaacatggtgaaatcccatctctactaaaaatacaaaaaaattagttggatgtggtgacatgcgcctggaatcccagctactcaggaggctgaggcaggagatatcacttgaacccaggaggcagaagttgcagtgacccgagattgcgccattgcactctagcctgggagacaaaatgagactcccatctcaaaaaaaaaaaaaagaaaaagactggcttaaatcacatcaaatgtttatttctgaaatttcttaaacctgatattttgtataattttaaatatttaggcttcagttaaactaccaaaataaaacttaacgtatctcagagtaaataggaaacacctagtggggatttcttttgggtgtctctgtcctaaatcagactcatagcttagcctttccaacctgttcttctttgtgataggtcagttttttttctcccccagccaaactgtatccagctttaaagatactttccaaaaacagtcatggtatttcaggcagaacatggacaatccttaacaatgagctaccaaaaaaaaaaaagccactataaaacccagtgaagtctcatttgatgctctgaacagggaaagtttagagtgaaggttgacacttcacatttagcatgttgtttaacaacttttcacaagccaaccctgactttcaggaagtgaaatgaaaatggcaggacttatctgaagatccacagtctagaaaaagcaaccactgctcttttgagggctgccatttcagtggcatcactggaaagtttgactgcctgacatattggtaaccagttattgggggttaggtcccaacaggtgtctgggtaaaagggagttaggtctgtgaaggtggggagggagaacaggatgtaaaaatgaatttgtttttccatcccacaaggtgtttgtgccaaggtggccatgtgtgttaaaagtcagggaatctaggctgggtgtggtggctcacgcctgtaatcccaggactttgggaggctgaggctggcagatcacttgtggtcaggagtttgagaccagcctggccaatgtggtgaaatcctgtctgtactaaaaatacaaaaattagccaggcatgctggcgggtgcctgtaaccccagctactcaggaggctgaggcaagagaatcgcttgaaccccggaggcagaggttacagtgagccaagatcgcaccactgcactccagcctgggcaacaatagcaaaactctgtctctaaataaataagtaaataaagtcagggaatttcttctataagccaagaggaagtctctcaaaactagaagggaaaggtgttttccccacgtcagtccagcttcaaagacattctattagtgacctgtgatccttcccaccaaaacaacaatgaagtgttctgtgtgcgataacaacactgctttagaaaaagcaaaacaaaattctgcatttttataaagcttgatttaaacaatggtatttcaaaatttacaaacttcataactttatagttcaaactttacagtcaccagaagtacacagttaccaaaaatgcacatgtttcacttggcatctctagcaccttcagctttctgtgcctggtctgttttggcatctccatttcctgcaaggttattcccctccctgccagtgtcagcattttcctttttccctttgggtacctcctctctctcctttgcaggggactttttttttttttttttttttcctgagaccgagtttcactcttgttgcccaggctggtgtgcaatggcatgatctcgactcaccgcaacctccgcctcctgggttcaagtgattcccctgcctcagcctcccgagtagctggcattacagacatgcgccaccatgcctggctaatttttgtatttttagtaaagatgggtttctccgtgttggtcaggctggtctcgaactcctgacctcagatgatcctcccacctctgcctctgaaagtgctgggattgcaggtgtcagccactgcgcccagcctgcatcctttttagggttgggctctggctttggaggagcaggtttagcatacaaccttgcggatcttctctgggttgttcttcaccttggctctatctcctttagcatccccttcaggctttctcttgggtgtggtggtgatgtggaaggatgtaagcgctgagtgcgggatgcagtggcatgtgggctttgatcggtccgagagtcactcttgactgttcttcctcagtgctccgtggcggatcacttttgaatgctggctctcccttagctcctctattcagtcagttccccaatcctgtcacttctactacccaaaaagcttttttatctatgcagttctctctgttgttctgggccagtactataattcaagccactgttttcacatgagttgtccagttattcctgtagcatacctggtcttcctacctcctttcaatcttttctgctcttgtgccaattttttctcaacactgcagtcaaattgcgtacacgaaaatgcagatgataaaaatctaaattgctttttcacaagatttacaaatcctttcagaatctagatcctgcttttttttctgtctcattttgttacttttccttcctcttcactacagatcctccagccaaactaaactgttttcagatttctaaatatcccatatcgtatcctgtctaggattttacccgtgctgccgcttttgattttcttcactggtcttcacttttgctagcttatagtcatctttaggtctcagtttatacattacctcctggggaagcctcactttttttggtggagaagacgtgtccttcccatgtcatctccaggcatggagtgattaccgggttacccactgtgttatgattcctgactacatacaaacaaatgtctatagacgaggggctacaaattatttgtcattgaatccttggtactcacattgggcctggtatgttgcagtttagtagatacttgtgaaatgaattaataaatgatatatcattgtaattattcttcactgatcattctgttcaaaattttccaaggcaaggctacagattttatgagttgattattattttaagcttgagtttattattggtatccatactaacttttaagtatatatttaatatatttttacttcatttactgcattaagcatacttaggcataaataatttgtttttgttttttttttgtaattatgagcttactttctttttataaccttgatatttatccctgcctcaggtggaggatgcgctatcttatcttgaccaggtgaagctgcagtttggtagtcagcctcaggtctacaatgatttccttgacatcatgaaggaatttaaatctcagaggtaaaagatgtgtgattgtactcaagctttgtatctggcatattgattttggaaggaagaggatatagtttatttactggaagataaaggatgctcctttttgcagctgaattttcaaaatcatgcctttattttatgcatacctttattgatggaaattatggccactagacttttttatccctattggtaaattttccttaactaaattttttccagtgttttgtctcaatcagggaagtagcactggtagtgatttaggctacttggtttctgaattggtttagatacccttatattctggcatggttcactgttgtaagagtgtaactcatctgaacaatgtagatgtgtgctgaaatgatgtatactggtatatcaaagagtgaatcttgtttgggatatgtagctttatatatatcatctgagtatctgcttggtagaattattacaatgaacatatattctgttaaaaattttgaccattccaaaaattagccgggcatggtggcgggtgcctgtaatcccagctacttgggaggctgaggcaggagaattgcttgaacccaggaggcggaggctgcagtgtgccgagattgtgctactgcactccagcctgggcaacagaatgagactctgtctcaaaaaaaaaaaaaacaaattgtggccaagtatctttgagtctaaaactaaatggctttggaatttcagagttcgtgtgttaattttaaaatgcgtagatgatctgttttcctgtttagagaaaacctagtagaaagtgaaattttgagtgaggtggctcatgcctgtaatcccagcactttgggaggccaaggtgggcggatcacctgaggtcaggagttcgagaccagcctggccaacatggtgaaaccccacctgtcctaaaaatacaaaaattagccgggtatggtggcgcatgcctgtaatcccagctacttgggaggctgaggcaggagaatcacttgaactcgggaggtggaggttgcagtgagccaagaccccaagattgcaccattgcagtccagcctgggcaacagagtgagactccgtctcaaaagaaaaaaaaacatgaaattttttcttaacagggtgtttgttaagcttacagtttatcacttttctttttgttttttatcagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagccccagctcctgcccagccagctcctcagcccccacctgccaaagtcagcaaggtgagcacttggaaaatattgcatcaatatgaatgcatccctagagagcaccttcctttgatgtttcccctttatataagacttagatactgagaaacaaagttacaaagatttcgtcatagaaaaatgctgtatgaaaacttcactatgacatggttcacatttacacatcacttacttaggtatctatttaaatcaacacagcaacaactttcaaggtctttctttttacagtttctgcttataaaaccatgaacatcccaacaggtggtgactttgtgtagtagtagttgacagcacagatagaaaccatcgtcttatcctggtcaaattgtgctgctgcccacatggttattttatgaaagttatttcactaactagattatatcaagctaagtagaagatctaatgaatagtgatagtgatggtgatgaagatggggtgttcttggtctagaaccacactgtctgacacagtagccactagccacataggactatttaaattaaattcagtttttcatttgcactagctttcaagtgctcagtaacctcatgtggctggtggctatgtataagacagtgcaaataaaggacatttccatcatctcagttctacaggacagagttggcgtagaagacttttttatgtggagctactgcaacagttgtcttgttgttgacatcaaaaggctatgtagaatgagattttttctatgtgtacttgttgagctactaagctaaaacattgcatatgaaaaattctttccctgtaattggagatggctccagttttaaggttttatttagaaaatgtgagactgaaatatttgtatcagcatgtttgaaccgcctacaactcccactgctgcccagtatgatttgtgttggactaaaatgacctggcctgagtgagtaaataaaggatatacgttgacaccttgtttctctttagtttgaactttccttgtatcaactcatctatgcatctgaagagaataaagatttcttttctttctagccctcccaactgcaagcacatactccggccagtcagcagactcccccacttccaccgtatgcatccccacgttctccgccggtccagcctcacacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcaggtaaggagtgcccattcagcctgtcttaaccaggtcaccctcttagggcatctagtccaataacaagtaaccattattgtgtccattaattcatactggaaattaaccagttagaaactatcatgcatgtttttaaagccagtttgtttgtttgtttgtttttcgagacggagtcttgcactgtcacccaggctggagtgtagtggcacgatctcagctcactgcagtctccgcctcccgggctcaagtgatactcctgccttagcctccctagtagctgggattacaggcgccgcccaccacgcccagctaattttttgtattgttagtagaaatgggatttcactatgttggctaggctggtctcgaactcctgaccttgtgatctgcccacctcggcctcccaaagtgctgggattgcaggcgtgagccaccgcccccatgctataaagccagttttatttgcctgacttgattgccctgcaacattcagtcaggatttttttttttttttttgagacagagttttgctcctttttgcctaggctggagtgcaatagtgcagtgtcggctcactgcagcctctacctcccgggttcaagtgatttcttgtatttttagtagagacggggtttcaacatgttggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactccagcctgagcaacaagagtgaaactcccgttctcaaaaaatatttactaccctagttttgaaaggaattgtcatccaccatcttcaactttttttttttctcaacttgaaaagtctgtggtcagaacgggtgctaagaacatagactttcttcttacatgcagcctaaatagataacagtgattccagaaagcgtgcaaagatgagtgactcaaaacagtagcccagatgatctcttttcatttgcaattcctcagaaagagcagagaaatgccaaggaagctggaggaaactacactccagcattgacagagcaggaggtgtatgcccaggttgctcgtctctttaaaaaccaggaagatttgttgtcagagtttggacaattcctaccagatgccaacagctccgtggtatgtttttttaataagaattacactatttactattattatcttagatgagttggaaaactgtgctcagaaggggacttttcctagatgatatttgtttgctttgataagagcattaatctcattcatgtgtcttaatcagcttttaagcaaaacaactgctgagaaggttgattctgtgagaaatgatcatggaggcactgtcaagaagccccaactgaacaacaagccgcagaggcccagccagaatggctgccagatccgcagacatcctacaggaaccacccctccagttaaggtgagaatgggcagcagctgctcattttgacactcacaagtatttctaatggagaggtactctagaggtggtcatgtgttttgttgttgttgtttttttttgtttttttgagaccgagtctcgctctgtcgcccaagctggagtgcagtggcacgatctcggctcactgcaacctctgcctcccgggttcaagcgattctcctgtctcgctctcccgagtagctgggactacaggcgcatgccaccataccgggctgatttttttttttttttagtggagacggggtttcaccgtgttagccaggatggtctcgatctcctgacctcatgatctgcccgcctcggcctcccaaagtgctgggattacctgtgcccggcagtcatgtgttcttaagtgtgttaacggttgggtcctagatatttggaggaagttagtattgtgtcacagaaactcagtgcagagtttatctggctttgcaaaagagtattagaataacattgattgcttggattactgtacttttctgagttctttattatctctcctttgcaatgagctgtcatttctttaatgttttggttgctactaagaatttccaatacttgaaatttttttcccttcttttttttttgagatggagtcttgctctgtcgcccaggctggagtgcagtggtgtgatctcagctcactacaacctctgcctcccgggttcaagcaattatcctgccgcagcctcctgagtaactgggactacaggcgtgtgccaccacgcccagctaatttttgcatttttagtagagatggggtttcgccatgttggccaggctggtcttgaactcctgacctcaggtgatccacccacctcggcctcccaaagtgctggaattacaggcgtgagccaccgcgcctggccccttcttctttgatgctttaaatctgccttgtgttaagaaagaacattcttgagcttgagaattatttcagaaataagtggtctctgaggtcctcttgtgagtagagtgcatgtgttttttgagatctctggtctagaaccctgtcctgctcaaagttctttgttgggttaccagatcttatgtgtatcatcttaatctccaaggcaggacctttgggctgtagcagagggaagtcttaaactcctcttagtaatccattacatgatgttttttgttatagttaacactgatggtctgcctgcagaaaacttagcttgctcccttctttgatgtaacacagctatgatagggagagggctagttgtatgtattgaatgtttaattcttcagtgaatttcaaagcagtatgtaatatagaagagacagatatgtctgcagaattaaataatgacaaaagtttgggaatttctaatagtaagaggtggctgatgaatagtgattgactgactacaaggtctgacgtactaggtgttactgacacttttgaagtatccttttcattagtgtttgtcatggtttcttcttttgaaatcttttgaaatcaagttgaacataataatggtttctatttcttcatttcaataaagagaattagttatatgggtagcaagaatcagctcagtagatacactccatgcttggatttacgtccgcccactcttgattacctacaggtggcaagaatatagtgggggcttaaaattctccgcctactttctccataggcagtgtaagcagaggctgcggctcttaagaaagtatactctgagatagccaaggtaaatgtgctacttctcacaaagtttgtgcatttcttcatagagagtaagtggtggattttaaaagtaacttcttgcctgacaggattatatcatggcctgttggttccctttagaagaacaatattaaattagtctgagtggatattgctggcgtgcctttttttttttttttttttttttttttttgagatggagtctcactctgttgcccaggctggagtgcagtggtgtgatctcggctcactgcagcctccacctcctgggttcaagcgattcttctgtctcagcctcctgagtagctgggaccataggcgcacactaccacgcccagctaatttttttgtatttttagtagagacggggtttcaccatgttggccaggatggtctcaatctcttgacctcatgatctgcccaccttggcctcccaaagtgctgggattacaggcatgagtcaccatgcccagcaaattatgctttttaagtaaatttttaattgaaatattattcagggttaaagattgatttctgtcaatttgtgagctctttttacaaacagccttttctccctcagctggtaggagaacaaaacagtggcattagattctacatgaagttactttgggcccctagaaaaagtaaggatattctaaaagtttgtcacagtaatgtcatgatcatttctggagaaaatattttgggggtagaatgatctttgaacctctgttgtagaaagaaacttaataggcaaactgaaatagaaaatatgagttgaaatcttagagggtatggagtgagttggttagagttctctcatttgtttcaaattattaatcagcagtggtttcagtgatgaaaccattgaatacagacaaaaataaaattcagagaaaaccactcgttgaatctcacatgtttgtatctttcttttgcagaagaaacccaaactgctcaatctgaaggattcttctatggcagatgccagcaaacatggtggtggaacagaatcgttattttttgataaggtgagtaatggatgagttagatttgatagtgcctgttaatgccaaaagaaaatcatcttatccccctggaaggtttcgttttaaaggtgtcaggctaattaggactttctgttttttaacatagtttcccagttgtgagtcctttgagtctgctagtactattagcatagctagaaaaatggtagcattgtttgctttggttttatgaagcagtttggggcagaagacagatttttagaaaatgtattatgtttctcttgaaagatgtttggagctcccattgtagatatccaggtctgtgtggcaggcagtaccagtgcctgtaccaatttttgaggatttaagatgacttgtaatctttttttttttgagacggagtctcgctgtcgcccaggctggagtgcagtggcgcaatctcggctcactgcaggctccgcctcctggggttcacgccattctcctgcctcagcctcccgagtagctaggactacaggcgcccaccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccgatgacttgtaatcttattgctgtgatagttatttgtagtacacacatacatagcattcaggggaattctaatttacttgcatgttttcaaagctacccagctgattctaatgagcaacgagagttgagattattggcataaatgatgttgtgtggtgccttagtttggccacataaacttaagtgtgatttgctcctcggagtcaacttgatgattagcaggaaactttcatcagggtagctggcacctgttgggcttctcactggtaggaatcaacctggattgatctgtggtgattgactctattttctgcctcttgggttttgcagaagggcagatgatttaacatctccgtgattagtatctcctgatccctttctgtctgctgtgcctatgtgagctttttgcaggagagtcctgcaagagtgttgagtccttagctctgatgtgaatcattaccaaagtctgcttgggcggttggtgctcttagacaagtgtggaagtctagatcacaaccaataaatgtcaagaaaagggtatggaagggaagctattataaattaagaattaagaaatatataagccaaatgtgacatgcagactttggattctgaatttaaaagctgatttatttttatttttatttttatttttgagacagagcctcactctgttgcccagcttggagtgcaatggcgcaatcttggctcactgcaacctccgcctccctggctcaagcgattctccagccttagcctcccaaacagctgggactacaggcgcctactaccgtgcccagctaattttttcatttttagtagagacagggtttcaccatgttggccaggctggtcttgaactcctggcttcaggtgatccacctcagcctcccaaaatgctgggattacaggtgtgagccaccacacctggccaatagccaatttttaagacattaattagacaattgaacttgacacggactcaatattagatgctattaaggaatcttttttacatttttgggtttttttttttttttagacagagtctcgctcttgttgcccaggctggagtgaagtggtgtgatcttggctcagtgcaacctccatctcctgggttcaagcgattctcctgcctcagcctcctgagtagctaggattacaggccccgccacaacgcctggctaatgtttatatttttagtagagatgaggtttcactgtgttggccaggctggtcttgaactcctgacctcgggtgatcagccctccttcgcctcccaaagtgctgggattacaggtgtgagccaccacacctggccttttttatttaagagatgggctcaagtgatccttcttaccctcctgagtagctgggacttgcaggtacagaccaccacactcagctaatttttaaaatttttttggagagagggggtctcaatgttttgccctggctggtctcagactcctgggctcaggcaatcctcctccttcggcctcagcatttgccttccaaagtgttgagattacaggtgtgagccaccatgccttgccttaaggagtcttctgaaaataagttaatttctaagagtaatgggttttttgtttttgtttttgtttttttgttttttttttattttttttctgggacagtctcactccattgctgaggctggggtacaatggtgtgatctgggctcactgtaacctccacctcccgggttcacgcaatcctcctgcctcagcctcccgagtagctgggattacaggcgcccaccaccacacccagctaatttttgtatgtttagtagagacagggtttcactatgttggccaggctgtctcgaactcctgacctcaggtgatccgcctgccttggcctcccaaagtgttgggattacaagcgtgagccactgcacccagtcctgtaatggcattttcttagtactttttcttaaacatatatactatatctagatgaaatgtctggaatttgctttaaaatgcagtggtaggagaagtaagtatagatgaaacaaaatttactatagatcattgaggttggggtgagtacataggttcgttatacttctgtctacttttgtgtatgtttaaaagctaataaaaagtaaaggtaaatagggtatacagtataaaaggtacagtgttcttttatctttagctttaaaagtctagattctatatagtgtctactgatgaatagttaagaaaagcatacggaagtctggagcaggggttgctgataagccacttggtttggtggcagtctgtggtcttcaccaaaggatcacagtgctaaatacttattttggaactgaaactccagattggtaatctagctagactagttttactttgtctatgccattgatcatttttgggtttttggtattaagatgctcaatattgtaaatagaggaagaaaaaagaccagatcagaggacagaactatcttaagagagcgttattccagattaccagagtttaaaacagccttggcaaagattcttgctgtaaacatgttaagagaggcaacaggccggacgcagtggctcacgcctgtaatcccagcactttgagaggccgaggtgggtggatcacctgaagtcaggagttcaagaccagcctggccaacatggtgaaaccccgtctctactaaaaatacaaaaaaaacattagctgggcgttgtggcaggtgcctataatcccagctactcgggaggccgaggcaggagaatcgcttgaacccgggaggcagaggttgcagtgagctgagatcgcgccattgcactccagccaggacaacaatagtgaaactcggtctcaaaaaaaaaaaagaaaaagaggcaacaaaaacctgagtaactctgatatggtgtggagaatcaagcatatgagaaggtatactccgagatctcagtttttaaattgttattatggtattttttttttgagacggagtttcgctcttattgcccaagctggagtacagtggcgtgatcttggctcactgcaacctctgcctcctgggttcaagcgattctcctgcctcagcctcctgagtcactgggactacaggtgcccaccaccacgcctagctaatttttttgtatttttttctttagtagaatggggtttcactatgttggccaggctggtctcaaactcccgatctcaggtgatccacccacctcggcctcccaaagtgctgggattacaggcgtgagccactgcgcccagctggaaaattttgaacatacataaacagaatagtaaaatgattcctcacgtacctaccatccagctttagcggttcccaattctagccagttacttgtttcatatatattcccacccatcccagtttatttggagacaaatcgcagataccttatttcatccatacatattttagtaagtttcttttaaaaatgactcctttttgtggctgggtacagtggctcaaacgcctgtaatcccagcactttgggaggccaaggcgggtggatcacttgtggtcaggagtttgagactagcctagccaatacggtgaaacctcgtctctactaaaaatagaaaaattatccgggtgtagtagcacatgcctgtaatcccacctacttgggaggctgaggcaggagaattgcttgaacccaggaggcagaggttgcagtgagctgagatcgcaccactgcacttcagcctgggcaacagtgctggactgcgtttaaaaaacaaaacaaaacaaaaaaactccttattgcaaacataatcattatcacatctaaaaacactaacgttgattccttagtgtcatcaaatatcagtttaaatttccccgtttttattttatttttttacttatgagacagagtcttgctctgtcacccaggctggagtacagtggcattatcccagctcactgcaacgtctgcctccagggttcaagtgataatcttatgtttcactcagccacccaagtagctggaattacaggcgtgtgccaccatgcctggctaatttttgtatttttagtagagacggggtttcagcatgttggccagtctgggctcgaagtcctggcctccagtgatccacccaccttggcctcccaaagtgctgggattataggcatgagccaccacgcccagccacaaatttccccagtttttaaaaactaatggcagggcagctgggcaatatatgacctcgtctctgcaaaaaatttagaaattagccaggcatggtggctcacacctgtagtcccagctacttgggaggctgaggatgggaggctgcagtgagctgagattacacaactgcgcctcctacctgggcgacagagcgaggcccttttcagttccccactttaagaaaaacaaaaactgtttttcttcccgttgtctccataaggtccgaaaggctcttcggagtgcagaagcctacgaaaatttcctacgctgtcttgttatttttaaccaggaggtgatctctcgtgctgagcttgtgcaactagtctctcctttcctggggtaagtgaagtgaggggcttagccctgatgcatgatatggagaccaggtaatgtttgatttgtgagagtatatgataggcaaagttaatttacttgagatacatcagttgactcaaatgttagtgccagaagagtcctgagaagtcttctagtccagctctagagatgagaaaatagagagggcattaagtatttatcgactaatggccaagactagtggtctcctgatcttctaaccagtgctggatgtttatcaagaaaaatctctcccagagttctggaatttttttaaaaattattattattattttttttttgagatgaagtctcactcttgttccccaggctggagtgtgatggcatgatcttggctcactgcaacctccgcctcctgggttcaggtgattctcctgcctcggccccccaagtagctgggattacaggtgcctgtcaccacacgcccggctaatttttgttatgttttttagtagagacggtgttttaccatgttggccaggctggtccagaactcctgacctcaggtaatccacctgcctgggcctcccaaagtgctgggattacaggcatgagccactacaccgagtctggaatctttactatatttgacaacctaagaattatgtgaacattaaagcaatattcttgatcaaaagaatggcttgttattttgcctggtttcggtacaactctttgatcaccactttaactgatctgagagtattttattagaaaaaggggaaaccaaatgctcagaagcagttcttcttaggcaggaaataattcatccctggtagcagatttctgatccaaaaccagatggtagtagtcatacctcaggataactgcatcctgcccctaattgcttgtcactttttggtttgattcttcaggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggtaaggccttccctagcaaagatcagccctgggtcctcagctttttccagaagggagtggtggtaccaaggattgagaatttatatgaatgatgaaattaagaacccttttaatcctttttaaaaagaaaatgttttctacttttttgtttgtttttgagacagggtttcgttttgtcacccaggctgtagtgcagtgatgtgatcacggctcatagtgcctcaacctcctgggctcaaatgatcctcccaagtacctgggacttacacatgccttcacacccagctaaaaatataaaaataaaagtttttagttttgtaaagattgggtcactcctcctgggctcaggtgatcttcctgcttcgtcctcccaaagcactggaattatatttccgcttatattcagcacccttttcttactaatagctttttgtaaacttgctaaaggtgaaatttgtgaagtaatattagttgcctatttctctgctagagttttgtcttttcattcagaatgcttaatcaccagaaagcttttttaggcttttgtttcagtctctcttcttctacccaaaggttttaaatgatacctgggtttccttcccttcgtggtctgaggactctacctttgtgagttccaagaagactcaatatgaagaacatatttatcgttgtgaagatgaacgctttgaggtacaagcttgtttggcatttgaagttgggggaaatgggagatgctcagtgagactatcagtacctgtctctgaggggtattaagatggaagagccaaaggctcacattcttctatggtaagtgcttgttgtggtactttccatgctttatgcattggtcaaatgtatatattagtacatgctttatggcaaatgtgacttatctaggccactttagcccttttaactgaaattgtccattgatgactaaataatagttcttttgattttgcatggcattttaagattattatgttttgcatggtgaagaaaatcagtatcctaaggtttatagtactttcttgaagctgtttttaaattatttaagatctgtgtgtattgttacccttagcaagtatcttgccatggttagcaaaccagctctgagaactggcatttttctttcatgtttctggtattgattgctttgttgttttttgtttgtttgtttgtttgttttgttttgtttttttgagacggagtctcgctctgtctcccaggctggagtgcagtggcgcaatctcggctcactgcaagctctgcctcccaggttcatgccattctcctgcctcagcctcccgagtagctgggactacaggcgcccgccaacacgtccggctaattttttgtatttttattagagacggagtttcaccgtgttagccaggatggtctcgatctcctgacctcgtgatccacccgtctcggcctcccaaagtgctaggattacaggtgtgagccactgcgcccagctgattgctttgttttgttttgtttttttgagacagggtctcattctattgcccaggctgcagtgcagtggcacaatcacagttcattgcagcctcaaccttccagactcaagtgtgatcctcccacctcagacccccacccctacccgccaccgagtggctgggactacaggcatgtgctaccatgcctgggtaaattttttttttttttttttaaactttaaattctgggatacatgtgcagaacgtgcaggtttgttacatagatatacatgtgctttggtggtttgctgcacctatcaactcatcatctaggttttaagccccacatgcattaggtatttgtcctaatgctctccctccccttgcctcctaccccctgtggctaattttttgttttttatagaaacagtgttttactacattacccaggctggtctcaaactcttgggtccaagcgatcatcccaccctggcctcccaaagtgctgggattacacacatgagccaccatacctggcctgattggctccttttgaaagaaggctaaattagggacccctttctttttaaagacagagtattgctctgtcaaccaggctggagtgcagtggtgtgatctcggctcactgcaacctctgcctcacgagtttaagccattatcctgcctcagcctcccaagtatctgggactacaggtgtatgccgctacacccggctaattttttttgtatttttagtggagatgggtttcaccatgttgaccaggctggtcttgaactcctgacctcaagtgacccacccgtcttggccttccaaagtgctgggattacaagtgtgagccactgcgcctgtcccaggagctttattttgaagtaattaggaagggaagagtggagtgaataaatgaggtggtagaaggccccataccacctatatcaggagagggactactgaaagtgggctcaatcctcagtgtgtttatatgtctggtttacattatcatttttaaaaagggaagtctggtttgtctaaagatgtaaaatgatacgtatcctatttagtgtatctgttacattaaattgactggctgtgcttatttgtgtggataggtatcttgctggtttttgtttgtttgtttgtttgttttggtactcttttagctctttgccagttttcccgcctcacacttggttcagcagtttctggtgtgtttttaattgagaaccacatgctgcctggccactggcaggtggttggccatctttgccccagcatttataaggagttgcacctatttgcagaaagctaaatcaagacagatgttaacttccatagggagtgttatcaagctaaagaaggcatttctttgttacttacgtttagtaaggttaactgatgagtttagcagagcttggcatttgtttttgacagagtgttcctatcctctctcagctggtatgcctccaaatgagaggcaacttcatttcccatttgtgactacaagggcaaacatgaaagaagtggggtgtgcatgtgtttaagatttggtgggatgagctagtttgaaggaatgtgcgttaccaatcaagataggttagtaatgcctcagtacagacaactcccacatctgagtgacttgtaaaaccaatgggtttaatttctaatcattctacatgtacattgatgtttagcaggggatttggcatatcagaattacttggggattcaggccaagggattgctgccattatgaatgttgctagtcactaggaggaaaagagagcttggaatgatctcacacctttaaatgctgcagcctagaagtaataaacattacttctactcatctcataacaactcattggtcaaaactagttacatggccctatccaatcataagggagccaggaagtttagtccattttttgttcataattggagagcaagaggggccagaaatattgaccaaatgactaccacattcccaaaacaagaaaacttagggaacacttctgcaaacagttggttgtagaccgttgagactgctcatttacttcattttctgtttctcatttagagaaccttattttaagctagggaaaaagtagactcaaaggttgccaggagtccaataagaatttaaatggttacccgcagctacaacagtgaactccttaagttatgatagtcactgctcttattattactggatgtggaacaaggctattgaatatttaagtatttgaatatatttaaatatttcaagttaaaccaaaaaactctcaagacaaagcggtcttttgggattgttttgattgttattgtttgttcataatggatcttagcaattcaggaaagttcagggaaacgtttcagtaaagtcatctcctgtttggttcctctggtctaaaatcagtagtcctaagcaaagcacacggtggtggtggcggcagcagcgacggtggtggtaataactaccatttatccaacttcatcctgtggttcttatgtgccaggtattgtgctaaatactttatgtggattgtatcatttaatccagacacagggttgtgagagtaataggtgctgttatccctattttgctgataaagaaacagtcttatgtagctagtagggcagaaccaggattcaaatccaaggagtttgactccctaccttattcttctaaacactactctattctattttgatttgggtcctgagcatacccttctttgtcttcctcttcagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggtacatgagcaaatgtgcccttagtgctttagtgtacttcactaccggttcagtgtctcattaaataaggctctcattttcaacctggttgtcccatgagacctctctttctccccaaccctggttgttggaattcaggtgcagaatggaacttcttttgggggtcctgtgtaaccaacattagagaacaaatcttgtaagttcatggtggaaggctctgtgtgtatgtttgggggagtattttaaaatacagaaaagaaaagaagataattaccacccatgttcctgccacactcaggactaactgttgttaacatctttgtggtttgtttgtttttgttttgttttgttttgagacaagatctcactctttcacccaggctggagtgcagtagtgtgaacacagctcactgcagcctcaacttcccaggctcaggtgatcctcccacctcagcctcccgaatagctgggactacaggaatgtgccaccacacccagctaatttttattttattttttttaatagagatgaggtcttgctatatttcccaggctggcctctaactcctgggctcaagcaatcctcctgccttggcctccccaaagtgctggcattacaggcacaagccacaccacacccagccccatgtcattattgaccacactgtgaatcctttgttaggagcttggttctctctcagtatcatctggtaaaaattaattcttatttgctgcacagttcacaaatacccagatttgatttgtcctccctcatcttcccctcaagagctggcacagattgatggtttcttctccctcatcttcccctcaagagctggcacagattgatggtttcttcttcttgcctgtagcatttaacttctggcttttgagatacaggttattcttcagttttagtgcttttttttgtcttagtctgttctcttctgggttattagaatcagttctgatcagaactttcctgactgtatccagaggaacataactgtgcaagttctcttgtcttggacttctgtgtttctattagcattgtgaacgttttgcaaagtcctatagcaaagaaacaagaactctttttttcaaggaatacttatacctgaaagatattccctggaatgctgtttttaagtaaccattctaggtaaattatttgactttgagataaatcatttcctcaaagtaagtcttggatgagtaattccctcatgaaacagagttcaagactggtttgatagcatcccaagttgccagtaattttgagagacctaatatagctttgcacctttctttaactaaagtaagcctggcaaatttctttcttctaaaccctctgaattcccatgtgttgtttccatcccttcccgcttcactaggttgaagatgaaagaggaagaatggcgagaagctcagagaggctttaacaaagtatggcgagaacaaaatgagaaatactacttgaagtctctggaccaccaggggatcaactttaaacagaatgacaccaaggtcctgaggtctaagagcttactcaatgagattgagagtatctatgatgaggtgagcggggggtttctgcatctgtgagaggactctagtctatatttagcacagctttgatttctggaaattacctttgttaaatgcaggtgagactctctaagacctgttgattcttgcttgatagctgtcatagccttttctattcctcattctaccattttaaatctaaactatacctttatacctaagctgtttgactagtttcctagtttactgtcctggtttcaacttatacctcctgcctccattttccacttctccgactacctgtttccttcaaacaataataccttgtatccatatagtcccatctctccttacttacagcttcaaaatttgtcattgaccaccaaactctttgtaatccttgcttattcagcatgcctaccaggactataaatagtactaggagctaggatcagagatgaataagcaataaatcctggtttccgtgggctcagttttaggagatggatagaaacataaatgcagtgcaattgggaattcctggagtggggtgatcctgaactttaaaaatagtaaaatgagctcttatgtgaacttaatcaggccgggcacagtggctcatgcctgtaatcccagcactttgggaggctgaggcgggcagatcacctgaggtcaggagttagagaccagcccagccaacatgacgaaaccccgtctttactaaaaatacaaaaattagccaggcgtggtggtgtgcacctgtagtcccagctactcggcagaatgaggtgggagaatggcttgaacctgggaggtggaggatgcagtgagctgagaacatgccactgcactccagtctgggtgacagagcaagattccgtctcaaaatcaataaaataaataaacttaatcctccatattttgctgatgttactttgtcaccctccatacccccaccccagaagtaacgtaaatcacagatctcatatcatatcctttatatagatactaatccagaattttgaaagatagtcccactgggcacagtggctcacgcctgtaatcccatcactttgggaggctgaggtggacagataacttgaggccagaagttcgaaaccagcctggccgacatggtgaaacctcatctctactaaaaaatacaaaattagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctggaaaaggaatattttcagatccttcagtataactggatattctttgatatgacaacaaaactaccagtgatagtttttgtttttgtttttcttttttgagacggaatttcgctcttgttgcccaggctggagtgcaatggtgtgatctcagctcactgcaacccctgcctcccaggtttaagtgattctcctgcctcagcctcccgagtagctgggattacaggcatgtgccaccacgcccggctgattctgtatttttagtagagatgggatttctccatgttggtctggctggtcttgaactcctgacctcaggtgatcctcccacctcggcctcccaaagtgctgtgattacgggtgtgagccactgcacccggccccagtgatagtttcttaaaggttagttggaatatcaatttatacatcagtgggcttttcatgcagttgtaaaaatccattgatttattttgtatcatgaatgaatctttttttcctctatgattttgtaactttacgcaattggctatttggaaaataagttatacacacctactaaatgttgatatattttacagtgtctccaaaagaaatcacattgatttaatatcgctatcgctaggtcatcaaacacatctttaagtattgggaagctgtcaagctcagggtggctgataccagttcaccaaaattcatagttttgcttgaaaattccagtcttaccattggcaacattgttttccttgaagtgataggctcccttgttcatttttgagaaaacatctgccaaatacttggctgagattgactatatttagtcagttgttctttcgggtaaaaatgatgatccacttacaactcaagcaattgctcaagtgcttttctataagaataccattgtactttagcacacaaaggtgctttatgtgtagttcccattttatcacacagcatgttaaaaagatgtaaattgaggggttgggatttaatagaaaatgttactgcttcatcagaaactttttttttctttttttttttttgaggcagagtctcactctgttgcccaagctggagtgcagtggcgcgatcttggcttactgcagcctccaccagccaggttcaagtgattctcctgtctcaccctcccgaatagctgggattacaggtgcgcgccaccactcccggctaatttttgtacttttattagagatgaggtctccccatgttggccaggctagtctcaaactcctgacctcaagtgatctgcctgcctcagcctcccagagtgctgggattacaagcatgagccactgtgactggcccatcagaaacattcttaagtgaaactggcttttttcacttaatgtcattgtatggtcagtgtgaagttcaaagacttgaattgcagtcgcatgaaggtgcaaaatcatggaagtaaaatggattcattgatggtacaagataaaccaacagagtttgacaactgtatgaaaagctcagtgatgtacaaattgatattggaatttggtaacaatttgttcgatattgcaaatacagtttggcgccaccaccagcatttttgttcaccattactttaatggtgccagtgcagatgtcaacacagcaaaaaagggaaataatgttttagtattattatgagaatagttttgatctcacagatctcctgaaagggtcctgggaccctttggacaaagaactgctgtctacagaaatacttgtatacaaagattctcactgaagcaatattttgggctggttggttttttttttttttttttaagacagtgtctggctctgtgtcccaggctatagtacagtggtgggatcttggctttctgcaacctccgccttctgggctcaaacgatcttcccacctcagcctcccaagtagctgagactctaggcacacgtcaccacacctgcctaattttttttttttttttgtagagaaggggtttttgccatgttgcccaggctagtctcaaactcctgagctcaagcaatccacctgcctcccaaagtgctgggattataggcatgagccacagtggccaacctgaagcagtgtttttaatagcaagttatgagaaacaatataattgtctagctgataacttttttcactggatgttgagatttagcaagcctaccacccctcagggcatccattcatgtgaattatcttctttcttgtgtatgtagaatggcactagtttatatcatctgggggaatttttaaaaatagtcattcaaataaatttttgttatgtggttcagatgaggaacctcagttgaaagaaactgttaaggaatggtaaattggggtacatttttctgcagcagttaaagagaataagacaaatctatcatgaaatgaaaaaatattcatgacagtaagtgaaaagttgaggacaaaatatatagtatgatcctattttgtcttaaaaacaaatcccaaagcagaactgtagctggtaattacatgtgtaaatttacagacagaggcctagaagtttctcattaaaactcttaactggctacatctgctaagtcaagtaggggatgggtgaagatttctgctttttattctgtgtacctttgcagttgaaattttttttgcagtgaaacaactgaacatttgtgtatgtatttaacaaattgggatgagtactatgcaagcatataataaagaaaactcactttggggaagtcacgggaatctgcatctggacgagctctcatcctccggggcttttctgcaataggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcaggtgagaaccagtaactgaaatttctgtacacatctcccaccctagctaggaccaggggaggcccagagtcttctgattgtttttctttgtttatgcaaacctgttcttggagctgagacttaactgaggaagtacgtatgttggttgctaaggatgctgtgacaaagtaccacagactgtggcttaaatgacaaaagttgtggagactagaagtccaaagtcaagtgtcagcagtgttggttccttttgaggactgtgagggacaatctcttctaggcctctcctagcttctggttctttgctggcaatctttggcattcctgggcttgtagatccctgccttcatcttcatatggtgttcctacctgtgtgtgtgtgtctgcctccagatgaggtcacattcggaagtactgggggctaggacttcaatgtatgattttttgtttgtttgtttgagacagagtctcacctgacacagcctctcaaagtgctagcattacaggcgtgagccaccatgcccggccaacataagaattttaaggagaatacagttcagcctgtaagagcacgtaaatacccggtggcacctttttgggtgaatttacttcccagtatttannnnnnnnnnnnnnnnnnnntgatcttttgcttgtatgaatcctacctgtctttacattctgtctcaattgtgaaaccttcctggtgcagctgcgtatagggtgttatgccaggccctgggactacagccatgaagtagagcagatgaagtaatgcgatgatatgcactaccagggaaacaaatcaggtgaagtgatcaagggtaactagcatacaggccttgctttcactggaggaggcttctcaaaggaggtgatgcttgaggcctgaataatgacaaggaattagcctggtgaagagtagaggatgggtgttttctagacaaaagagctagtacaaggctgggaggaaaggacttggcatattcaagaaattacaaacaccattgtggctcaaggttgcatgaagttagaagggtaggcagaggccacatcactttgtctaatgataggccatggtttgtaatttgtttgagatgcactgggacatttgacaaagatagcttggagttctgtgaggacagtggagatgggtatatataaagttggaagagcagagaccactcaaaagggtgcccttgtccaaatgagatgtgggggccacccgtactactagggtggcagtggaattgcaagaattacattgtagactttatgcatttatttttgagacagagtttcgctgtgtctcaaaccatgcctggctgattttttgtatttttagtagagatgggatttcaccatgttggccaggctggtctcgaacctgacctcaagtgatccaccctcctcagcctcccaaagtactgggattacaggcgtgagccaccacgcccagatgtagatattatttagatatttaattgacaagagatggtgttggatcaaatgtgggggtaagcaaaagaaggacatcaaggatggtgcctgattagttttggggttttttggtttgttttgttttgcttaagtggagattttaggggctcacctgttaataggaaagggttatgaggtttgggagacagatgaagtgctgttttaagtttgaaaggactacaaaactttcaaatgggagatgttgagcagacagtttaatgtataattaaccctttaacgacaaggggtttggggcactggcccctgcacagtcaaatctgtgtataatttttgactcccccaaaatggaactactgatagtctactactgactggaaggcttactgataaacaacatattttgtatgttgtatgtattatatatactgcattctttttttctttcttttttttttttttaatgaaaatagacacggggtctccttacgttgcccagggctggtctcaaactcaagggttcaaacaacccacccatttcagcctcctaaagtgctgggattacaggcgtgagccactgtgcccagcctatactgtatattcttacaataaagtaagttagagaaaagaaaatgttaagtcataagcaagagaagatacatttactcttcattaagtggttgtggctcatcataaagggtccttattctcatcttgttgagtaggctgaagagggaggaggaagggaggggttgtttttgctgtctcagggttggcagaggtggaagaaaacttgcctatcagtggcccctgcgctgttcaaagctgtgttgttcaagagtctgctctacttctctcatggcactgagggaagcgcagtggcatgatttcagctcactgcatcctccacttcccgggttcaagagattctcttgcctcagcctctcgagtagctgggattacgggcgtgcaccaccacacctggctcattttttttgctatgtgttgtgtgtctgcctgtctctgattcacattatttgggacactgggcaacaccagttttgtctttgtatctcttctagtatccttgcatgtggacaccaataaatttttattgaatgtgttggtgggaacagaaccccctgcagaacatctgccaagcctggactctgcttcccagggtggggtaacacagtggagggagagtggttttaagccctttgctttgcactgtctggcttagaggtggatctccatgctgatagaagtgatcaatggctcactgggtcctacccaggatacattagaatcagctggattgctggtttaaaatgcacattggtaaaccaaggaaatgtgggttttgggggttttgggttttttttttttttttttttggagacagggtttggctctgtcatctaggctggggtgcggtggtgcgatcttggctcactgcagcctccacctcctggctcaagcgatcctcccacttcagcctaccaagtagctgggactacaggtgtgtgccaccacgcccagttattatttgtatttttgtagagatggggttttgccatgttgcccaggctggtctcaaactcctgagctcaagcgaactgcctgcctcagcctcccagagtactaggattacaggcatgagtcactgcacctggtcagaaatgtgtattttttaacacattccctcggttatactaacgcatgctaaaattgagaacagcgagctttttcagcccagagcctgtgttcgcatttctttggaggctttatggattttcatgccctcacatgttctatgttcttacctctttaacttctctttaaacagagaatccttttttttttcttttaagaaaaaaacagtggtatctaagacttgagcccacatctttcctttgctcctttagaagaaaattaggctttgtatttgaagggctcttttttggttctgcttcatttaataaaaaattttttttctgttttgcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaactttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaagtgtgcataaggcatgtggtataccttataaatggagttgggagggagagaatttgaaatgggatacctatttttttaattacataaatttaaactagcagacatttaaacatgaatgattaggatttttctatgtggttaacctggactttctgaacaaagaccaactgagcccctcccagtactctggtggatttttcttcagcaaccattacgcaagtcttagttgtaaccagcaatgttctgtgtgttttatgtttgctttttagttaaaaatcaccaccaccaccaaaaagaaaaacaaaattttttggctcctggattttcaaaacacatggtagacctctctgattttaggcttttattgtttaaagacagtgtctcgctttatgacccacactggagtgcagtgccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtattttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtgatggagaaggtctggtgtggcgtgatggagaacctgtccaggtgaggaaccctgtcctagggccaggtatggccacatttcagccctgaaatgactacagcccttcttctgtggactctggagaagccacagctgagttgctctgcccacagggtggtatcaggatttcaggactagggaagttgccacttgggcatctgtgcaattggtccttagtttttattgtgtataatacaaacttataggaaaacatttcaaacagttctagataaagtaatggatctctccttatcacccatcccattccccagctataaccactgttaagtgtcttattcatgctccacccttatcaggtttagtccttatactcctatctagtaggtctttatacccatttacaaattaagaaacagatgtgtagttgactcactcaggttcacacagcttctatttcaaattggactgactctcaatctggggttaagactgttcttcctggctacaagaaggcagagaccatcccttcctcccttcactggctcagcaaatatctcctggtgtccattctgggccatacccttaagcactagggtgtagcagggaatgaggcaaacctgcccctgacttcacggagtttctttcccggtatttatttaggggtgcagaggccaccagaatccacactcaggctgcctaaccccttcccagggcccttcccataagaccatgggtttgccactggtaaacaggggctatttgacggtcatggtgctggctgccatgggagttggggcatctactgccaagggtccctgatttgccaatcttggccctgcttgggagagaggacccagagctgggaaccagatggaggggcctgactccccatggcttacactttacctgaactgtccaaaagcctcaagccttgtctctctcactcccctccctactagggtttaaccaaagagggtgagaagaccagctatgtcctgactgacaggctgggggaaagagacccccgaaggtgagtccctgtgccctggttgaccagtgctgtcagggagggagtaccagtgagcaaggaggagctgaggcccagagtgatctcataagcccgcctctgctctagcacaatcatcctcacatctcattgtttgcttttaaaagcatgattttttcctaaccataaaaataatgggctgggtgcagtgacccacactaccctgggaggctgagtgggaggatcacctgagcccaggaggatgaggctgcagtgagccatgatcacaccgctgcactgcagcctgggcaacagagtgagaccttgtctcaaaaataatagcaatgtttgcctgtggtaaatacaggaaagcacaaagaagtaaataactaccgttattccactccctagaatagagatgaacattattaacatctcagcattcatgttcttttttttgagacgaagtctccctctgtcgccgatgctggagtacagtagcacgatcgcagctcactgtaccttctgcctcccaggttcaagcgattctcatgcctcagcttcccgagtagcagggattacaggtgtgtgccaccacgtccagctattttttttttatttttggtagagaaagggtttcaccgtgttggccaggctactctcaaattcttgacctcaggttatccgcccctctcagcttcccaaaatgctggaattacaggcgtgagccaccgcacctggcccagtattcatgttcttggtgtatctttccggcatagttttttttgttttttcgggggggtttttttggatttttttgagacggagtttcgcttttgttacccaggctggagtgcaatggcacgatctcggctcactgcgaccgccgcctcccaggttcaagcaattctcctgcctcagcctccctactagctgagattacaggtgcccaccaccatgcccagctaattttttgtatttttagtagagacggggtttgactctgttggccaggctggtctcaaactgctgacct

SEQ ID NO: 14403 - DNA, 20727 bp, Human
  misc_feature (1)...(20727): n = A,T,C or G
tgaggtggagatggagaagaaaggattattggaaatgggagcagagggagaaaggaaggagcttagaaaggaagaggccaagtttccagcttggatgactgggaggcaagtggcacctttgattaaaatagatcatacaatgaggaggagaagatttaggtgacttgatgagctcagagttgcacttgctgagtttgaggtgtctcaagcatctcagcggcagtgagaggtccagcaatcaataggtagatggaactgaagttcaagggagtagcgaaagctggggatacggattcagaactcaccagcctggagatggtatgtgaaaccatgagataacttgatacctcccagggagagtttatgacgtgaaaagaaaaatgggacctaaccagcattcttagagacaggatcttgtagcaacagagcagaaatctccaggtagaaacaggagaatcaagaaaatatgaacatgcggagtcaaggaaatgcaaggtacccggaacaagcagtaggcaaatccaatcacaaaggagcagaaacaaactacccagtggatttggctataaagttgtagctacatggttcagattggaatggagaagccagaagagggatggaggaactgactttgaaaaggaggaacatcgccttatcagaagttggagggggaaggggtggaggatggagaccagtatttatatgtttataggggaaggagcaaggtcaggtgttgtggcctaaattgtttttgaagtagggtaccagatatctgctgagaaaggtggtgtgagtgggtgataatagctgcagagaccatttaagaggaatgggaaggttaagagtggccactggggagactgggatgggcacctggccagactgaatggatcagtgggtgatttagtgggcccagttgtcacaagttccacattttagagactatttattctccagttgctctgggagtagagaaggtggcttgtagcaccttttctttttccaggttgaggttttgtagaaggtgttaccaatgccaagaccctcctgctcccttgactccagttgccttggctccttaaggagtcccagagtgacagagaagaagcagtggccattttttctgcaaaagctttggctcttttatgaagtccatgatttctaccatgtcatgaaagccaggtccaagcctggagttaataagtccaagatcctctacagcctcttctcagtctcatgccttccaatctctagggcagcctacatatcaaaagggatttacaggggctactctggtgcttcttttgtccaagaacctttgtctgtcctttgccattccaaaatccatcatcaccaaattagccattccaaaactgctcagcattagaaatccggagttgggtagattctatggaccaataaatggaatttttcgaaacatccacactcccttctttcctttcctatgtgtcctcttagtctaactggccccaagctcagtggccttcagacagaagcagaaatgttccaagatgattagctaggaacacaaggtacaactgaaaatccattgtgcaaacaagtgcctgtttgattttctcttcacttccctttgggtattaagcttcctttcaattcgtgtttggtttctggtaataaatatggcaccagtttcattgattgattatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggaggtaagtcctgctttaagccccaggaggcttcctcctaatcctgggaaatcttgatccactggacatgctaggattctttgtttctggaaatttttagaacccagcaagtagtttggaccctggccattgtcaagtgctccaggtaccactctatgtccaactcagtcatgcttccagtcatctgcgatgctccaggcctacggacgccaccctcttccttgtcccagatattcccaccagggaactaggtctctattgggatctcatctctaagaatcaccaatcctgggtgcttccctatccctgctgtctcatagcatactcatggtatccctgcccgaaaccgatctctattttccactgaagtcttccagaggttgtaggaagttatccaaagatttggccatttagggaaagtatttcccagaaaagtaaatgccatccaaatgctggcaggcttttttgcagctctttctttctgcctcgccaccgcccccaacccccattgatttatttattcatccttaatcctctactgagtactccttgtgtgccagattctgtactaggagcaaggaacatggggctcggtttggcatggttccacagtcacagaaatctacatccatagaggacatttcagggggctcttagcagcacccaatgcataaaactaagaaagggcagccattacttttgtgtgcaggtattcacaggtaccatatccctttttctctatccaatctccaaagagcctctacttccacctgagcagggaccatcctgagacctttctaggacattctgcagtactagccagctctaagcttgcctttggtttgcttactgtcaattttatcacccattatctcgctctatctgtccataagtcacacctactttgaaacaatgcagctctttatgaaggaagtcaacggatctgtttctaagaacatagacctatgccctaatcttatcttggtcttttctttcccatagctgcatgggaagtctgcatacagcaaagtgacctgcatgcctcaccttatggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcaggtaaggaagaggaattggcagttctaaagcaaaaactcagagctagaagtcaagggaaacataatgagaaacaatggaaatcaagtcacaatctctcaaagagcctaatcagaaattcctctgaaagggcagtgggagccagttaacataatttcccatgcccatatctttgggagattagagaccccagattaaagaagatcaagaaatacataactcagtcaccttgtgctggcaagtgccttctccttttcctgaaagggctagattaagtgatctctttatgaagtgggcaattcagatacttgcagaaaggagtctcaggcttagaattagagtgcaaatttcagcccctggaggagggtgggagagggtactgagctcattggaggcctccagtggaaaaatacaatctaagaataacaaatgcagtgattccttgtcttaaaataagtacatgcatgagcaaagtttgaaaatctttttttctgaaaggcccttctaatgtgtattataagcatgtgcaaagcttgaaaatctcttttttttagaaagcccctttaatgtgtattgtaagcacatgatcctgtgtgtgcacttagctccttcttcaggcatctacagcattcaacaaaatagaactagagaagacaattagcttgaccctggtgctgtgcttggcattttacacatattatcacatttaatcctctaacaatcgtttaaggctttctttccccaaatgaggtgtatatattccaagatggttctgggggtgcctggcaaactcttaacaagtttttaatggctgtatgtttattttttatgcacatctaaaaaatataactagcacatgatatctatgttatcacagatattattctttaagatgaaactaattcttaaaagataatcattgaaagaaacattttaagtcaataataggacaggcaaacacatgtatgacaaaggtcatgacccaaagcataggaacggataaagtttgagaaccactggttcacaggtgtggttttgccaatgagtctcaggggacttaagtcacctgccaaggtcacccagccagcaggtgtagaattggatttaaactcagcctgaccagcctgtggtcttcctccttcacttctctgcctcttcatacatcacagtttctaaaactgtttttaaaaatggtagatcaacaatcagaaatggtcttgttagatcagtggttctcaactgggggcgatgccccccaagaagacatttggcaatgcctggagaccactttggggcatgctggtgggatctggtaggtagaggtcaaggatactcctaaacattctataatgcacaggatggctcctccagtgaagaatgacctagccaaaatgtcaatagtgccaaggttgggagttcttgcaatagactgtgctactggtatggaaaaatgtctatgttatattaagtaaaaaatgcaagtggaaaaaaagatgttgcacagaattaaacttatttttatttttaagaaagcaatatattttaaacttgcctaagaagaaggctatattacaaatttattgttacttctggggatgagatgggcttatgacaactttcatttctgctttattaattttaatgatgtttgaggttctttttcagtgagcctgtattacatttataatgagaaaaacaaatattggtcaaacaaggctgctgtgtgcatgatgcacaggaaagaactttgttactctgaggcagggagggaggctgtgcaggacggtagccctgctgtcctcaatgcctgtaaaataccacagaaggtcctcactgattattctgcccccaaggtgatgaagttgatgtttaattaatggaccgtgtgtgtattgtcctcattggagtccttagcacagccaaaatagagcatggaggggaaaaaatcctgtaggttctggcattgctcagtaaacccaactgcactctgtcactttcccaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagatgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacaggtgagcagcagagccctggaggaggcagctacacagccaatgagatgcctcccaggctcagtagagtgagtggagcaagtcaagaggagacaggagaggatgcagagcagcctcgactcagctcctgcccagtgagaactcaacacaggggttgagaccttccaacatttcaagccagaaattcccattcaagggtgaaatttcctagtttataaatgtgtgtagcataaaatccagaactcatgctcgttccgattttggctccatttgagaagtttaatttgcctccctgagcctcagtgttctgatctgaaaaaaaggggggggggtaacagcaaaaataacagctaatacataatgctcacaatgtccttgttgctatcctaagtacttcaaatgtattaactcatttgatcctctccccagttccacgaggtaagtgctacctaattaccccaattaggggcacagagagattaaggggctctcctagtatcacagagctggagcatggtacagctgggatttgaacttggcattctagctccagcatccatggccttaaccaccatgctgtcctttctcattttgattgaataggctaatacattccttgtccttagaatagagtcttgcctgtagtaagtgttcaggtggcagctttagggctctcacttatcccattggactgggagtcaggcttgatgcttccactaagtatcacacaaccttggcaagattcttgtgccccggtgaaatgaaagggttggacttgggggcctcaagtccagcccgcactgcatcctgatcttctctctccatgccccatcacctagacccatccactgtggaggacaagtgtgagaaggcctgccgccccgaggaggagtgccttgccctcaacagcacctggggctgtttctgcagacaggacctcaatagttctggtgagctgctcactgggcaagtaactaccatcctgagggggcagggcaggagggagggagctttagagggtcaagataaggtataaagcagagtcaggggcatggacctgaggtcaagggaatgtgggctctccaatccatttgctgtaaagccagtgggtttgcaaggataggagggcagggttggagcaaatttccaggtcagctgctgggccgtggcctcaggaaatggttctgacatgggcaggcttgacccctgagggatgaagacactgaagatgataattctgctaatgtaggagctatgttttcatagccacagggtcttcatgtcagggacatgggcagacttctggggacaagtcactactgtctctgagcctgaatgtcctcatctgtaaaatgaggataaggtaataataatacccaccatacagggctattgtgagaactaaatcagagcagtccaattgggcaggctcaggaggtgatgaatttctcgtcccaggaggtaagcaagcagagtgagatgtcccatgggtagggatgtcatagacaaacaagcactaagccctggacaggggatggatgagcctcccactgagattatttccctccatcactgaactctaacaagggcctttgatcttgcctttggcacaagcatgccttcctctgagcacactacaagtccctatggaagagagagtgttctaggcagcaggacaagaaggagcatgacacatttggaaaacggagccacagtgtgaacagggcgatgcttagatgtgcccagcagaagcaccctgggaaatgaggggtagggaacaaccaacaaccttgatctccttgaagactctttctgctcattgagtggataaggccccagagattcagtgtggttttctggggtttgggcccatcacagagtcagattttgggctttaaggaggccctccctgtacctggatgggctccaaggacagtctcagctgactgagtgagcaggtggcctgcctcaagtcttcatcagtggccagcacaatgatgagtgtccagtgggccccattgcttgcagacacatccctctgtgctctgactttcacttccatctccttctcccacaccctgctctcattttaggttcctgcgcctctgaactctgaaattccacaaatgcaccattccctctatcccatctccatgcttttgcctctcctgttcccttagcctgggatgcgttcacttgctttactgacttgcaaaactcctacccacgtttcaaatttcataccactgtgaatccttccctgacttcaccaagagactcagatagaccttcttctctgctccccctccatctgtacatacttctgtctgtatctttatcatattgaagtataataaactgttgatatgttggtgtttacacaagaccaagaaatcctcatgggccaagtccatgccttatttacttcatgttgaatgcacctagcatttgagaaggtggttggtaaagtggctcatgcctgtaatcccaacagtttgggaggctgaggccggcagatcgcttgaggtcaggagtttgaaaccagcctggccaatatggcaaaaccccatctttataaaaatacagaaattagccaggtgtggtggctcatgcctgtaatcccatgcctgtaatcccagccttgggaggctgaggcaggagaatcacttgaatccaggaggcagaggttgcagtgaactgagattggaccactgcactccagcctgggcaacacagcaaaactctgtctaaaaaaaaaaaaaaaaaagagagacagagagagagataatgtggttggtaaatatatattgaatcaatgcattaatgaatgcaatagaaactgtcttcctattagtttactatttgtctcccctattcaactgttagctctataagagtgggaattttttcagttttgataagtgttgtagccccagtgcctggcagatagtagattctcaagaagttgtgtgttgaataaatgttgagttaaaatatgatagctctgaacttggtcagatgtgctgactcaacaaggtagcatatatctaactttgattctagtatggaatgcaagtccatcctgcctccccaaataacacaatccccaagaggaactagactaaaaaaccttagcaagcctgcacataggacacttggaaatcttgaatgaggggccccctttgccagtcccacctactgccagcctaggcatgaattccatctggatcccagggaccttctagtctacataatcttctgggtcatggagatgttaccaaagagtagggaaagtgggcttccagactcatgtccattctacttgccttcatctctgctttgcagatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggaggtaagtggctttcacaccactgctgccagaaggtatgtgttgggctgatgggacctatcatagtagctctgagatcttggacaagccacttagcttccctgagcccccagggttgtgtgagagtgcacaagttggtttacataaagagcttagtataagtctgacatgtgagtttcataaacgtaagctacaattatgataatttcaattagggatggtgggggagggatgcacagagaagcaagcttgttggttcctgactcttcccaagggtcaataatttatcgttctagttttttgcctggtttcctcattcgccttcccataaagtgtcagtaacactgaaggaagaggtcccttgacctccatgagctcagaaggtagggtggctgcatggttaagcaaattgactctggaaatcagatctggatttgagatacacctacatacacatacacataaacatctgtatggttttgtttttttgccaaagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaaggtatggcattgacccttgccctttgacccataaccctggcaatagtcacatcacacttacttcaagtgcagactatgatgtccacaccatactgccagcctcctccaggagcctccagtcattcagtcattcattccacaagtattcattgattgtatattaaagatgttcagcatgaacaaggcagacatagactattccgtggctattaaagattgttataactaggcaatgcagcaacatgaaacagtgcttactaaatgtgctagaaaacaaaaacacaggacaagttcaaagttcattcaccttgaggaacaaaggtattaaacaactaattaaaccaataattacttataagcaagatgagtacaatgtaaaagaaatgtggggtgctttgggagcagggaacaggggttccagacccctgttggtggtgggtttgatggggacagaacagcttccctgcagacgtgagatttaagcagagaccagcttttatcggataaacaggcacccccgtccccagcagaaatagcatcagatagcaatttgggcaggggcttttctctgttttgttgtgtttctgtgctgaaatggggccctgttgaatcagttccttagcatccctagacttgctaggggactttctgagatgtcaaaaatccagagtgcccgtctcattccctattgctccctgggatcacaaagcaacaggatcagaaggattagacattttctaattcagtggtttccagatggtttggtgctggggctcctggttcataaaaaatcaaaatgaaagccatttatcttgttaaaattggtgtttcactgaagactgtggaatgcagggaagagatctgttgctaaaaaatgtgaacacacagaactggttctcagccccactctgcaggtgagaagatggaggtatacactcagttattccttcagcaagggagatatgtgtaacctgtcctgcagggaggatcggtggaaatcccagagacagacttgtctgtcaagtttagtgcctagaagctaataaatgctcagtttaaacgactgattgactagttcacttaaggatccaagatgtgtgtccttgccttcgtaagtgtgttaagtaagtgcagggcttgatttatgttgttctctgaggtttccactcttgtggctttctttttctcagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacaggtaacgagcaattctggaattatcatttggccttactaacgtttacaggaaagtgttcatctcatccatccccagcagacgtgtaagttgtactacatatcataaccacaatctttgacccagaaatatcactcctgagattttagcctaaaatattaatactaaacaggtgggcagggtaaataaatgtcaatattttccatttcaatatcgttgataactttggcaacaggctgattgttcaaaaatagggaatcaatttggtagtgatggattattacacagaagtgaacactggtcaatatgaaaacaatatgataaatgttgtggggtgaaatatcattaaacatgcccggctgacaaaaacaagggaaaaatgcatttctatagatcatgatttaaattatagtaataatcctagctaatatttgtcattgagctatggcacattagctatgtgccaagcaatatgtggattatctgattaaatgctcacatcagtctcataaagtgtatattactgtctccactttacagataagaaaagtaaggttcagtaaggatgagtaacctgcccataatcacttagctagaacgtgggtcaggctacagtataaaaccagtctgtttcactccagagactgtgccctcaaataatttaagccatgtgcgcttatggataacatcttggaggaaacagaggaacagaaaaagtccacgttatcatgatggagggaacccgagggactctttaattttctccactgctgtttttagaagttacacctttgcccctgtcaccctcccagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagcctgtgagtgtctctttgaactgaactcttcagagcctggcatggagcctggtacctgataggctttccatatatatttattggaattataaacgcagggagggtgggagggaggggaaagggagggacaggaagagaagggtaaaggggaaggggaaagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagggagaaaggaatacaggagggatggagaaaggaatacaggagtgatggaggaggaaaggagggacagggaaggagagaaggaaggaagcaggatgaagagacggaacgagataggtaggtgtatggatgggagggagggaaaaacgaacaataaatagatagactctagatctcctaaaggcccatatctaagcaatttttgtgtccccaggaggcagatttgataaagaaatctgtctactagattccattggcatcttttaaatgattataatcatagatgacttttttagtgcttgcactttgtcaagcactatgctaaaacttctgcatacattttttaatgtaagtctcagaacaaccctgtaagtagattattttgcctactccactgtgaggttcagagaagtccttgcccacagggccacacacaattagaaaatatcagagccagggtgtgccccagccgagaggtggctccagtgcccctgctcttgcctgcatttggaactgcctgtgaatagttggcattttccgagtgcttactttgtgcccatgtgttgcagacacatctcattttcatcttcacaaccaggtaggtattatttagttattgtagaaaggcaaagtcattggccccaaattatatagctaaaagaaagtctctacttgatgagattcaaacccagatttgtttggcatgacagtgataattttctagattgagataaccacagcatcggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtaagtggccaaatcccagtgacaagaccagctggctgagtgttgacagttaaccacagatgcctggggtcaccaactcaacttctcagggctcttgtaccacctcagtctgacccttactgaaaaacctattctttgagatgctttgggtaataatgacaatattgtcatttggacctcctgtgtgcttagagaccaggctaagctcttgcatccatcaattcacttaatcctcccatgcctatgtccattttacaggtgagaaactaagactcagagagattaagtgactcgcccaagatccccctactcatgagtggctagagttaggattgaacccagctcagtctgattccaaaacatgtggccttttccttattccacctgcttccaggtccccataattcagttccttatgggtgaggcgtaagtcctaaatcccgtctaaatgcaactttgttttctggtgaatgactgttttccaaaattcatttacagtattctggagtataatataggggaggctttccaatgactcctcatattttcatccatcctactcatgggtttacagtagtgtttagttagtgtttttatttccaccaggatggagaagtgaaagaatgaaagccttttttttcccctaaaggaattaagatgcagtaatgttggtaataataatactttctttgtgcctggcactttgtcaaatgcctttatatgcatgatcactttgaaggctcacagcaggtgagggaggtaagcattatcaccatttccattctccagagcaaatggaggctgtctcatgaagtaggctctgccctgagttttcctaccatttcactgagctctcaacttgaagcctcaggtggcatcacagggtaacttggtggaggttaggaacttccacttttgaatcagacatactggggtttgaatcccagctctgctactgactggcaaggtcaacttggcaagtcccttaacatcactgagctccagtcttctcatctgtcaaatggggatgagaatactttcctcacaaatctgttaggaggattaagtctaagatgcacgcaaagtgtctagaaaggtgcctgtgccagattctagatgcccccacaatgtggccacaaacttgctggtggttgcgatggccaggtctaggaggatgtgaagcagttatggccacagtgttgcagtcactggagcatgactgaggaaacccaccccttctgttcttgttcacaggtgcacagtctcccggtgtcatgaatggaacccctagcactgcaggtacatcattttctcatgcctttcccacagctttcccaactctcctttctcttttcaattctgccccttttatggcccagaccctatgctagggacactgacattaatcagacctaagattggcctttgagatgcccacagtatagtggaggaggtagtcctttaacaagaaatatatactgagtgcccactgtgtgccaggccttcttctaggcactgaagatgtgatggcaaacaaaacagcccaggtgcctaccctcatagagcttatgcaccagtgtggaaagtagaaaataaaaaagtaaacatggtactttagaaataaaagaaagtgatgtgatagataatgccttaaaaaaaaaagaaattcatttctttttttttcaaactcaagaacttttttttttttttaattcattttactttaagttctgggatacatgagcagaacgtgcaggtttgttacataggtatatatgtgccatggtggtttgctgcacccaccaacctgtcatctaggttttaagtcccgcatgcattaggtatttgtcctaatgctctccctccccttgccccccatcccctggaaggccctggtgtgtgatgttcccctccctgtgtccatgtgttctcattgtatagacattcatttctgtcacacataaatgaagcttagaggcaagctgtccaaggctagcggggcagcaccataaagctgtcaaagacccaggctccttccaactcatgcctccaccatctttgaggtgtggccatcatcttcatgttccaagatggcagccagagctccaacctttgtatccaggcagcaggatggagggaacaaggaagaagccaatgagtgttaaaagacattcccgaaagctggcaccttatatctccacttacatctcattggccagtgcttggtcacatgccacacattgctgtgaagaaagctaggaaatgtaatctttactctgggtgggccatgtgcctaaccaatgtttgatggctttattagcaaggtaggaaggaagaatgactatcagaatggataagtggtcagaaaaactttcagagtaagtgatgttgaagccaattgagaaaaatgagtcggaggtgcaaatgttaggggaatgagccccatatgcatgggaacatcaataattcattgcacaagtgagacagacacttgagcaaataaatgacaagcaagtagatagtacagaaagagtacataaaaggctaaataactgtattggataaggtctggaaagaatttcaccaggtagtaacatctgaatggggttttgatgaatgacttggagctaaacaagctaactaataaaagaaatatcacactcacacacacacacgcagagagagagagagagagacagagagacagagagagagagagaacatttttacatttttttacatatttatagggtactagaaatatgtcttggacaaaatggaaagcacatactattaagatttgctttcccacaaaatgacttatattggtgaacccaaacatgaaaaggttctttccatcctcaaagcccaaacttaggtggcagtttttaaatttcccaaataagtccaagatggactctctatgttccgtgctagcattcagaaaatgctaagaaaagtcacgctcattgagaggagtggttagagctcattctaaaagcagcttaggccaggtgcggtggctcatgcttgtaatcccagcactttgggaggccaagacaggcagaccacctgacgtcaggagttcgagaccagcctgaccaacatggagaaaccctgactctactaaaaatacaaaattagatgggcatggtggtgcatgcctgtaatcccagctacttgggaggctgaagcaggagaatcacttgaacccgggaggaggaggtttcggtgagctgagattgcaccattgcattccagcctgggcaacaaaagcaaaactccatcaaaaaaaaaaaaagcagcttgaagtcaagaacctcaagtctcattcctttctgccagtccttctggttagcccagtgcctggaacagtgtggtttcccagtagagtttgccaaattgactaatttctagaatgggtggtagattttggacgcttctggacaaggaggggatcagtctgatgttgagacagcctacccactacaagagggcacttgtggttttcattgtctgctatcacaatcatctttgatgttttagaattaattgaacatcaacctgtttttataattataactttttgtcatgtactgttctgaaatttatgatatttctctcctcacttctaggacatcagccagttactttgaaattggggtaatggggagattttacaatttggtagtatggcaggaaggctcacatatttctcctaggccctctgatacaagaccattatcatctgggatccacgtccttcactgaaactgagtacacagtgatgtgccaaagagatacaatcccagcagaactagatcttagagtctagcttttaaaaccaacatttatatagtgtttaccatgtgccaggcaatggtctcaatgcttaatatgaactcactcatttaagccttacaaaaatccagtgaagtcacagctgctattaatatttctctttggcatacaggaaaatacaggcagagaggtttaataacttttctgggactgcccagctaggtgtagagctgagattctaagctaagtaatcaggcatcagaggcagtgctttttaacctctgtgtctttctgccccttcagtattagtcagcataaataatgctagctgctgtaacaaacagtccccagtcttctgtgtctttagacgacagtattgtttcccactaaatcactgggggaggggatgcagttctgctccatgtagtcgttaggagctcaggcttctactaccttctggtaacttctggtaactccactatcccctgcaagtcctatcttggatcctctgcatctgctccctagatggttgatgagagagcaacaggatatataggaggctttaaggatcagacctagaaatggcacagatgacttctatgcacattttattgaccagattcggtcacatggccccacctagttgcaaaggacactgggaaaaattgcattcctgtgtgtccagaggaaaatgaaaaaaatggttggtgattagattgcctctaccatgtgagtcccagagactataactaggccagatatcaaagatgctttgcctttctcatccttgtgttgtgaaagacaaagaggccaacttatgtttgctcctgactcccaaagcccaacacttgacagtcatatttcttgtatttcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataagggctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaatctcagctgtctatctgtctagctacctgtcatctatctatccatgtatctatctatgtatctatctatgtatgtatgtatctatctatctatcatcatctacctcctatctacctatcgtctacatacctacctactc

SEQ ID NO: 14404 - DNA, 20727 bp, Human; identical to SEQ ID NO: 14403
  misc_feature (1)...(20727): n = A,T,C or G

SEQ ID NO: 14405 - DNA, 19181 bp, Human
  misc_feature (1)...(19181): n = A,T,C or G
aggagtcccagagtgacagagaagaagcagtggccattttttctgcaaaagctttggctcttttatgaagtccatgatttctaccatgtcatgaaagccaggtccaagcctggagttaataagtccaagatcctctacagcctcttctcagtctcatgccttccaatctctagggcagcctacatatcaaaagggatttacaggggctactctggtgcttcttttgtccaagaacctttgtctgtcctttgccattccaaaatccatcatcaccaaattagccattccaaaactgctcagcattagaaatccggagttgggtagattctatggaccaataaatggaatttttcgaaacatccacactcccttctttcctttcctatgtgtcctcttagtctaactggccccaagctcagtggccttcagacagaagcagaaatgttccaagatgattagctaggaacacaaggtacaactgaaaatccattgtgcaaacaagtgcctgtttgattttctcttcacttccctttgggtattaagcttcctttcaattcgtgtttggtttctggtaataaatatggcaccagtttcattgattgattatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggaggtaagtcctgctttaagccccaggaggcttcctcctaatcctgggaaatcttgatccactggacatgctaggattctttgtttctggaaatttttagaacccagcaagtagtttggaccctggccattgtcaagtgctccaggtaccactctatgtccaactcagtcatgcttccagtcatctgcgatgctccaggcctacggacgccaccctcttccttgtcccagatattcccaccagggaactaggtctctattgggatctcatctctaagaatcaccaatcctgggtgcttccctatccctgctgtctcatagcatactcatggtatccctgcccgaaaccgatctctattttccactgaagtcttccagaggttgtaggaagttatccaaagatttggccatttagggaaagtatttcccagaaaagtaaatgccatccaaatgctggcaggcttttttgcagctctttctttctgcctcgccaccgcccccaacccccattgatttatttattcatccttaatcctctactgagtactccttgtgtgccagattctgtactaggagcaaggaacatggggctcggtttggcatggttccacagtcacagaaatctacatccatagaggacatttcagggggctcttagcagcacccaatgcataaaactaagaaagggcagccattacttttgtgtgcaggtattcacaggtaccatatccctttttctctatccaatctccaaagagcctctacttccacctgagcagggaccatcctgagacctttctaggacattctgcagtactagccagctctaagcttgcctttggtttgcttactgtcaattttatcacccattatctcgctctatctgtccataagtcacacctactttgaaacaatgcagctctttatgaaggaagtcaacggatctgtttctaagaacatagacctatgccctaatcttatcttggtcttttctttcccatagctgcatgggaagtctgcatacagcaaagtgacctgcatgcctcaccttatggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcaggtaaggaagaggaattggcagttctaaagcaaaaactcagagctagaagtcaagggaaacataatgagaaacaatggaaatcaagtcacaatctctcaaagagcctaatcagaaattcctctgaaagggcagtgggagccagttaacataatttcccatgcccatatctttgggagattagagaccccagattaaagaagatcaagaaatacataactcagtcaccttgtgctggcaagtgccttctccttttcctgaaagggctagattaagtgatctctttatgaagtgggcaattcagatacttgcagaaaggagtctcaggcttagaattagagtgcaaatttcagcccctggaggagggtgggagagggtactgagctcattggaggcctccagtggaaaaatacaatctaagaataacaaatgcagtgattccttgtcttaaaataagtacatgcatgagcaaagtttgaaaatctttttttctgaaaggcccttctaatgtgtattataagcatgtgcaaagcttgaaaatctcttttttttagaaagcccctttaatgtgtattgtaagcacatgatcctgtgtgtgcacttagctccttcttcaggcatctacagcattcaacaaaatagaactagagaagacaattagcttgaccctggtgctgtgcttggcattttacacatattatcacatttaatcctctaacaatcgtttaaggctttctttccccaaatgaggtgtatatattccaagatggttctgggggtgcctggcaaactcttaacaagtttttaatggctgtatgtttattttttatgcacatctaaaaaatataactagcacatgatatctatgttatcacagatattattctttaagatgaaactaattcttaaaagataatcattgaaagaaacattttaagtcaataataggacaggcaaacacatgtatgacaaaggtcatgacccaaagcataggaacggataaagtttgagaaccactggttcacaggtgtggttttgccaatgagtctcaggggacttaagtcacctgccaaggtcacccagccagcaggtgtagaattggatttaaactcagcctgaccagcctgtggtcttcctccttcacttctctgcctcttcatacatcacagtttctaaaactgtttttaaaaatggtagatcaacaatcagaaatggtcttgttagatcagtggttctcaactgggggcgatgccccccaagaagacatttggcaatgcctggagaccactttggggcatgctggtgggatctggtaggtagaggtcaaggatactcctaaacattctataatgcacaggatggctcctccagtgaagaatgacctagccaaaatgtcaatagtgccaaggttgggagttcttgcaatagactgtgctactggtatggaaaaatgtctatgttatattaagtaaaaaatgcaagtggaaaaaaagatgttgcacagaattaaacttatttttatttttaagaaagcaatatattttaaacttgcctaagaagaaggctatattacaaatttattgttacttctggggatgagatgggcttatgacaactttcatttctgctttattaattttaatgatgtttgaggttctttttcagtgagcctgtattacatttataatgagaaaaacaaatattggtcaaacaaggctgctgtgtgcatgatgcacaggaaagaactttgttactctgaggcagggagggaggctgtgcaggacggtagccctgctgtcctcaatgcctgtaaaataccacagaaggtcctcactgattattctgcccccaaggtgatgaagttgatgtttaattaatggaccgtgtgtgtattgtcctcattggagtccttagcacagccaaaatagagcatggaggggaaaaaatcctgtaggttctggcattgctcagtaaacccaactgcactctgtcactttcccaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagatgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacaggtgagcagcagagccctggaggaggcagctacacagccaatgagatgcctcccaggctcagtagagtgagtggagcaagtcaagaggagacaggagaggatgcagagcagcctcgactcagctcctgcccagtgagaactcaacacaggggttgagaccttccaacatttcaagccagaaattcccattcaagggtgaaatttcctagtttataaatgtgtgtagcataaaatccagaactcatgctcgttccgattttggctccatttgagaagtttaatttgcctccctgagcctcagtgttctgatctgaaaaaaaggggggggggtaacagcaaaaataacagctaatacataatgctcacaatgtccttgttgctatcctaagtacttcaaatgtattaactcatttgatcctctccccagttccacgaggtaagtgctacctaattaccccaattaggggcacagagagattaaggggctctcctagtatcacagagctggagcatggtacagctgggatttgaacttggcattctagctccagcatccatggccttaaccaccatgctgtcctttctcattttgattgaataggctaatacattccttgtccttagaatagagtcttgcctgtagtaagtgttcaggtggcagctttagggctctcacttatcccattggactgggagtcaggcttgatgcttccactaagtatcacacaaccttggcaagattcttgtgccccggtgaaatgaaagggttggacttgggggcctcaagtccagcccgcactgcatcctgatcttctctctccatgccccatcacctagacccatccactgtggaggacaagtgtgagaaggcctgccgccccgaggaggagtgccttgccctcaacagcacctggggctgtttctgcagacaggacctcaatagttctggtgagctgctcactgggcaagtaactaccatcctgagggggcagggcaggagggagggagctttagagggtcaagataaggtataaagcagagtcaggggcatggacctgaggtcaagggaatgtgggctctccaatccatttgctgtaaagccagtgggtttgcaaggataggagggcagggttggagcaaatttccaggtcagctgctgggccgtggcctcaggaaatggttctgacatgggcaggcttgacccctgagggatgaagacactgaagatgataattctgctaatgtaggagctatgttttcatagccacagggtcttcatgtcagggacatgggcagacttctggggacaagtcactactgtctctgagcctgaatgtcctcatctgtaaaatgaggataaggtaataataatacccaccatacagggctattgtgagaactaaatcagagcagtccaattgggcaggctcaggaggtgatgaatttctcgtcccaggaggtaagcaagcagagtgagatgtcccatgggtagggatgtcatagacaaacaagcactaagccctggacaggggatggatgagcctcccactgagattatttccctccatcactgaactctaacaagggcctttgatcttgcctttggcacaagcatgccttcctctgagcacactacaagtccctatggaagagagagtgttctaggcagcaggacaagaaggagcatgacacatttggaaaacggagccacagtgtgaacagggcgatgcttagatgtgcccagcagaagcaccctgggaaatgaggggtagggaacaaccaacaaccttgatctccttgaagactctttctgctcattgagtggataaggccccagagattcagtgtggttttctggggtttgggcccatcacagagtcagattttgggctttaaggaggccctccctgtacctggatgggctccaaggacagtctcagctgactgagtgagcaggtggcctgcctcaagtcttcatcagtggccagcacaatgatgagtgtccagtgggccccattgcttgcagacacatccctctgtgctctgactttcacttccatctccttctcccacaccctgctctcattttaggttcctgcgcctctgaactctgaaattccacaaatgcaccattccctctatcccatctccatgcttttgcctctcctgttcccttagcctgggatgcgttcacttgctttactgacttgcaaaactcctacccacgtttcaaatttcataccactgtgaatccttccctgacttcaccaagagactcagatagaccttcttctctgctccccctccatctgtacatacttctgtctgtatctttatcatattgaagtataataaactgttgatatgttggtgtttacacaagaccaagaaatcctcatgggccaagtccatgccttatttacttcatgttgaatgcacctagcatttgagaaggtggttggtaaagtggctcatgcctgtaatcccaacagtttgggaggctgaggccggcagatcgcttgaggtcaggagtttgaaaccagcctggccaatatggcaaaaccccatctttataaaaatacagaaattagccaggtgtggtggctcatgcctgtaatcccatgcctgtaatcccagccttgggaggctgaggcaggagaatcacttgaatccaggaggcagaggttgcagtgaactgagattggaccactgcactccagcctgggcaacacagcaaaactctgtctaaaaaaaaaaaaaaaaaagagagacagagagagagataatgtggttggtaaatatatattgaatcaatgcattaatgaatgcaatagaaactgtcttcctattagtttactatttgtctcccctattcaactgttagctctataagagtgggaattttttcagttttgataagtgttgtagccccagtgcctggcagatagtagattctcaagaagttgtgtgttgaataaatgttgagttaaaatatgatagctctgaacttggtcagatgtgctgactcaacaaggtagcatatatctaactttgattctagtatggaatgcaagtccatcctgcctccccaaataacacaatccccaagaggaactagactaaaaaaccttagcaagcctgcacataggacacttggaaatcttgaatgaggggccccctttgccagtcccacctactgccagcctaggcatgaattccatctggatcccagggaccttctagtctacataatcttctgggtcatggagatgttaccaaagagtagggaaagtgggcttccagactcatgtccattctacttgccttcatctctgctttgcagatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggaggtaagtggctttcacaccactgctgccagaaggtatgtgttgggctgatgggacctatcatagtagctctgagatcttggacaagccacttagcttccctgagcccccagggttgtgtgagagtgcacaagttggtttacataaagagcttagtataagtctgacatgtgagtttcataaacgtaagctacaattatgataatttcaattagggatggtgggggagggatgcacagagaagcaagcttgttggttcctgactcttcccaagggtcaataatttatcgttctagttttttgcctggtttcctcattcgccttcccataaagtgtcagtaacactgaaggaagaggtcccttgacctccatgagctcagaaggtagggtggctgcatggttaagcaaattgactctggaaatcagatctggatttgagatacacctacatacacatacacataaacatctgtatggttttgtttttttgccaaagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaaggtatggcattgacccttgccctttgacccataaccctggcaatagtcacatcacacttacttcaagtgcagactatgatgtccacaccatactgccagcctcctccaggagcctccagtcattcagtcattcattccacaagtattcattgattgtatattaaagatgttcagcatgaacaaggcagacatagactattccgtggctattaaagattgttataactaggcaatgcagcaacatgaaacagtgcttactaaatgtgctagaaaacaaaaacacaggacaagttcaaagttcattcaccttgaggaacaaaggtattaaacaactaattaaaccaataattacttataagcaagatgagtacaatgtaaaagaaatgtggggtgctttgggagcagggaacaggggttccagacccctgttggtggtgggtttgatggggacagaacagcttccctgcagacgtgagatttaagcagagaccagcttttatcggataaacaggcacccccgtccccagcagaaatagcatcagatagcaatttgggcaggggcttttctctgttttgttgtgtttctgtgctgaaatggggccctgttgaatcagttccttagcatccctagacttgctaggggactttctgagatgtcaaaaatccagagtgcccgtctcattccctattgctccctgggatcacaaagcaacaggatcagaaggattagacattttctaattcagtggtttccagatggtttggtgctggggctcctggttcataaaaaatcaaaatgaaagccatttatcttgttaaaattggtgtttcactgaagactgtggaatgcagggaagagatctgttgctaaaaaatgtgaacacacagaactggttctcagccccactctgcaggtgagaagatggaggtatacactcagttattccttcagcaagggagatatgtgtaacctgtcctgcagggaggatcggtggaaatcccagagacagacttgtctgtcaagtttagtgcctagaagctaataaatgctcagtttaaacgactgattgactagttcacttaaggatccaagatgtgtgtccttgccttcgtaagtgtgttaagtaagtgcagggcttgatttatgttgttctctgaggtttccactcttgtggctttctttttctcagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacaggtaacgagcaattctggaattatcatttggccttactaacgtttacaggaaagtgttcatctcatccatccccagcagacgtgtaagttgtactacatatcataaccacaatctttgacccagaaatatcactcctgagattttagcctaaaatattaatactaaacaggtgggcagggtaaataaatgtcaatattttccatttcaatatcgttgataactttggcaacaggctgattgttcaaaaatagggaatcaatttggtagtgatggattattacacagaagtgaacactggtcaatatgaaaacaatatgataaatgttgtggggtgaaatatcattaaacatgcccggctgacaaaaacaagggaaaaatgcatttctatagatcatgatttaaattatagtaataatcctagctaatatttgtcattgagctatggcacattagctatgtgccaagcaatatgtggattatctgattaaatgctcacatcagtctcataaagtgtatattactgtctccactttacagataagaaaagtaaggttcagtaaggatgagtaacctgcccataatcacttagctagaacgtgggtcaggctacagtataaaaccagtctgtttcactccagagactgtgccctcaaataatttaagccatgtgcgcttatggataacatcttggaggaaacagaggaacagaaaaagtccacgttatcatgatggagggaacccgagggactctttaattttctccactgctgtttttagaagttacacctttgcccctgtcaccctcccagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagcctgtgagtgtctctttgaactgaactcttcagagcctggcatggagcctggtacctgataggctttccatatatatttattggaattataaacgcagggagggtgggagggaggggaaagggagggacaggaagagaagggtaaaggggaaggggaaagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagggagaaaggaatacaggagggatggagaaaggaatacaggagtgatggaggaggaaaggagggacagggaaggagagaaggaaggaagcaggatgaagagacggaacgagataggtaggtgtatggatgggagggagggaaaaacgaacaataaatagatagactctagatctcctaaaggcccatatctaagcaatttttgtgtccccaggaggcagatttgataaagaaatctgtctactagattccattggcatcttttaaatgattataatcatagatgacttttttagtgcttgcactttgtcaagcactatgctaaaacttctgcatacattttttaatgtaagtctcagaacaaccctgtaagtagattattttgcctactccactgtgaggttcagagaagtccttgcccacagggccacacacaattagaaaatatcagagccagggtgtgccccagccgagaggtggctccagtgcccctgctcttgcctgcatttggaactgcctgtgaatagttggcattttccgagtgcttactttgtgcccatgtgttgcagacacatctcattttcatcttcacaaccaggtaggtattatttagttattgtagaaaggcaaagtcattggccccaaattatatagctaaaagaaagtctctacttgatgagattcaaacccagatttgtttggcatgacagtgataattttctagattgagataaccacagcatcggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtaagtggccaaatcccagtgacaagaccagctggctgagtgttgacagttaaccacagatgcctggggtcaccaactcaacttctcagggctcttgtaccacctcagtctgacccttactgaaaaacctattctttgagatgctttgggtaataatgacaatattgtcatttggacctcctgtgtgcttagagaccaggctaagctcttgcatccatcaattcacttaatcctcccatgcctatgtccattttacaggtgagaaactaagactcagagagattaagtgactcgcccaagatccccctactcatgagtggctagagttaggattgaacccagctcagtctgattccaaaacatgtggccttttccttattccacctgcttccaggtccccataattcagttccttatgggtgaggcgtaagtcctaaatcccgtctaaatgcaactttgttttctggtgaatgactgttttccaaaattcatttacagtattctggagtataatataggggaggctttccaatgactcctcatattttcatccatcctactcatgggtttacagtagtgtttagttagtgtttttatttccaccaggatggagaagtgaaagaatgaaagccttttttttcccctaaaggaattaagatgcagtaatgttggtaataataatactttctttgtgcctggcactttgtcaaatgcctttatatgcatgatcactttgaaggctcacagcaggtgagggaggtaagcattatcaccatttccattctccagagcaaatggaggctgtctcatgaagtaggctctgccctgagttttcctaccatttcactgagctctcaacttgaagcctcaggtggcatcacagggtaacttggtggaggttaggaacttccacttttgaatcagacatactggggtttgaatcccagctctgctactgactggcaaggtcaacttggcaagtcccttaacatcactgagctccagtcttctcatctgtcaaatggggatgagaatactttcctcacaaatctgttaggaggattaagtctaagatgcacgcaaagtgtctagaaaggtgcctgtgccagattctagatgcccccacaatgtggccacaaacttgctggtggttgcgatggccaggtctaggaggatgtgaagcagttatggccacagtgttgcagtcactggagcatgactgaggaaacccaccccttctgttcttgttcacaggtgcacagtctcccggtgtcatgaatggaacccctagcactgcaggtacatcattttctcatgcctttcccacagctttcccaactctcctttctcttttcaattctgccccttttatggcccagaccctatgctagggacactgacattaatcagacctaagattggcctttgagatgcccacagtatagtggaggaggtagtcctttaacaagaaatatatactgagtgcccactgtgtgccaggccttcttctaggcactgaagatgtgatggcaaacaaaacagcccaggtgcctaccctcatagagcttatgcaccagtgtggaaagtagaaaataaaaaagtaaacatggtactttagaaataaaagaaagtgatgtgatagataatgccttaaaaaaaaaagaaattcatttctttttttttcaaactcaagaacttttttttttttttaattcattttactttaagttctgggatacatgagcagaacgtgcaggtttgttacataggtatatatgtgccatggtggtttgctgcacccaccaacctgtcatctaggttttaagtcccgcatgcattaggtatttgtcctaatgctctccctccccttgccccccatcccctggaaggccctggtgtgtgatgttcccctccctgtgtccatgtgttctcattgtatagacattcatttctgtcacacataaatgaagcttagaggcaagctgtccaaggctagcggggcagcaccataaagctgtcaaagacccaggctccttccaactcatgcctccaccatctttgaggtgtggccatcatcttcatgttccaagatggcagccagagctccaacctttgtatccaggcagcaggatggagggaacaaggaagaagccaatgagtgttaaaagacattcccgaaagctggcaccttatatctccacttacatctcattggccagtgcttggtcacatgccacacattgctgtgaagaaagctaggaaatgtaatctttactctgggtgggccatgtgcctaaccaatgtttgatggctttattagcaaggtaggaaggaagaatgactatcagaatggataagtggtcagaaaaactttcagagtaagtgatgttgaagccaattgagaaaaatgagtcggaggtgcaaatgttaggggaatgagccccatatgcatgggaacatcaataattcattgcacaagtgagacagacacttgagcaaataaatgacaagcaagtagatagtacagaaagagtacataaaaggctaaataactgtattggataaggtctggaaagaatttcaccaggtagtaacatctgaatggggttttgatgaatgacttggagctaaacaagctaactaataaaagaaatatcacactcacacacacacacgcagagagagagagagagagacagagagacagagagagagagagaacatttttacatttttttacatatttatagggtactagaaatatgtcttggacaaaatggaaagcacatactattaagatttgctttcccacaaaatgacttatattggtgaacccaaacatgaaaaggttctttccatcctcaaagcccaaacttaggtggcagtttttaaatttcccaaataagtccaagatggactctctatgttccgtgctagcattcagaaaatgctaagaaaagtcacgctcattgagaggagtggttagagctcattctaaaagcagcttaggccaggtgcggtggctcatgcttgtaatcccagcactttgggaggccaagacaggcagaccacctgacgtcaggagttcgagaccagcctgaccaacatggagaaaccctgactctactaaaaatacaaaattagatgggcatggtggtgcatgcctgtaatcccagctacttgggaggctgaagcaggagaatcacttgaacccgggaggaggaggtttcggtgagctgagattgcaccattgcattccagcctgggcaacaaaagcaaaactccatcaaaaaaaaaaaaagcagcttgaagtcaagaacctcaagtctcattcctttctgccagtccttctggttagcccagtgcctggaacagtgtggtttcccagtagagtttgccaaattgactaatttctagaatgggtggtagattttggacgcttctggacaaggaggggatcagtctgatgttgagacagcctacccactacaagagggcacttgtggttttcattgtctgctatcacaatcatctttgatgttttagaattaattgaacatcaacctgtttttataattataactttttgtcatgtactgttctgaaatttatgatatttctctcctcacttctaggacatcagccagttactttgaaattggggtaatggggagattttacaatttggtagtatggcaggaaggctcacatatttctcctaggccctctgatacaagaccattatcatctgggatccacgtccttcactgaaactgagtacacagtgatgtgccaaagagatacaatcccagcagaactagatcttagagtctagcttttaaaaccaacatttatatagtgtttaccatgtgccaggcaatggtctcaatgcttaatatgaactcactcatttaagccttacaaaaatccagtgaagtcacagctgctattaatatttctctttggcatacaggaaaatacaggcagagaggtttaataacttttctgggactgcccagctaggtgtagagctgagattctaagctaagtaatcaggcatcagaggcagtgctttttaacctctgtgtctttctgccccttcagtattagtcagcataaataatgctagctgctgtaacaaacagtccccagtcttctgtgtctttagacgacagtattgtttcccactaaatcactgggggaggggatgcagttctgctccatgtagtcgttaggagctcaggcttctactaccttctggtaacttctggtaactccactatcccctgcaagtcctatcttggatcctctgcatctgctccctagatggttgatgagagagcaacaggatatataggaggctttaaggatcagacctagaaatggcacagatgacttctatgcacattttattgaccagattcggtcacatggccccacctagttgcaaaggacactgggaaaaattgcattcctgtgtgtccagaggaaaatgaaaaaaatggttggtgattagattgcctctaccatgtgagtcccagagactataactaggccagatatcaaagatgctttgcctttctcatccttgtgttgtgaaagacaaagaggccaacttatgtttgctcctgactcccaaagcccaacacttgacagtcatatttcttgtatttcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataagggctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcagg

SEQ ID NO: 14406 - DNA, 19181 bp, Human; identical to SEQ ID NO: 14405
  misc_feature (1)...(19181): n = A,T,C or G

SEQ ID NO: 14407 - DNA, 23319 bp, Human
  misc_feature (1)...(23319): n = A,T,C or G
tcctgcccaagtctttgtcaagaaaactccagaagccacctggggtcactgtctttaatcctttgaagacacccataataaggtttagacaaggcctcatgaaaaaggtataggataaaaacgactagttcagaaaaaaaaaagtaaataaatgaagagataacttcccttttcatcaaagaattgcaaaaatgaacaataatgagatcgtttccacttatccttttggcaaagatgaaagcaagttaccaatgctcagaactggtgagtagtgttggtgggattgtaaaccaatttttaataattctctggggtgctgtttgggaagaggagtcaatattcctacagctgtgctacctctttgacccagaatttccactccttggacataatcctgaggagatgacaacaccagtgccagtggttaccctaccactgagtgggacaggatggagaaatgtcctgaaaagagcaattcacaatagcaaagacttggaaccaactcaaatgtccatcaatgatagactggattaagaaaatgtggcacatatacaccgtggaatactatgcagccataaaaaatatgagttcatgtcctttgtagggacatggatgaagatggaaaccatcattctcagcaaactatcgcaaggacaaaaaaccaaacaccgcatgttctcactcacaggtgggaattgaacaatgagagcacttggacacaggaaggggaacatcacacccaggggcctattgtgggatggggggagcggggagggatagcattaggagttatacctaatgtaaatgacaagttaatgggtgcagcacatcaacatggcacatgtatacatatgtaacaaacctgcacgttgtgcacttgtaccctaaaacttaaagtataaaaaaaaaaaagatcaatgcagtgatcatggtgatattttcctgctcagcccaagttcacacatattttatttttctcaacatgatgacagccactctcacactgacttttggaatgtcatgtatgttgaactgggtctgaagacatggttttaactcaggctctgtcattttctacctcagtgattgcacaacagcaaagcagaattttcactacttccatgaatataatcattactatatgactttacttgcatcatctcctttggttactattactactgtgggagatgggtattctcattttatagacaaggaaattgacctctggacctcaggaaggttaagaaatgagcccactgccacacaataaacaccagataaaggaggcagactgactccaaagtcagtctatttaagtgcaaatttatttcgcctccaaagggacctcccagtcatcagacctgattctttgttgtacagagtgggtcaggtccagtgatgtccgaactaccttctggttctgactttcagccattctcagctcctctcttgcttgtgtctggattctaaggctgatctcatgagaatgggtgtttcagaagggtgccctctccaagacaggtgcacctcccatctggggcagtgaatatcccttttgtccttatgcagcctggcttcagatactggcttctgcctggctccttgatcccaccctgcccttgtcagtgaccaagaagaagcccagcaccttggcactgctttcccagttaatttctaactatggaatctcttgctgttagaaggtgcgaaacagtgaccttgtatttccgggcacaggtgtgaccccccaatgtcaatcatttggggtctctagctattaggaaaaagaacaacaacaacctcacagcttggacaaggcaaacattatgccaggaggaaaaaatattccacccccaagaaaacaatatcaaaaaacagaactagagactaattggaggagagattgccagcctggggcaaatgtgtatatataagtatgaggcacatcatgaccagactaactctacctttctggcttcaggtaaggctatctgtagctgtcttctcctagcccagcttctccccatcctatttgagggaggtaggagaggaaattaagaccttggacactggggtcagacctggatttgagtcattattctgccaattattggcttcatgatctttagtaagttagttttcctctctttgatcctctctgtcctagtaacaatgactactattttttgacttattccatgaatattagttatgcacctattatgtgccaggtaccagggttacaacaatgaacaacttgctatgtgctgggccctgctcgacatatgtcatcttagttaatcccagtgacaatatgcagtgttttaggtcgcatcttattagcgggtcataaaatcattccttttgtgggttatatccagggacttcttttaattaaatataatagaatatgtcagtaagcaatacaaatttgaggcaagcagttagcctctttgtccccctgttttctcatctgcaaactaggataatacttatctcatagggttgtggtaagaattaaatcacttaatgtagtaaggatatcaattgtcttataaaattttatgtgtgtgtgcacatacatgcagaagcgactgcactagatcatgacataaaatgtttttctttctttctgtcttttttttttggggggggggggatggactctctgtcacccaggcaggagtgcagtggcacgatctcagctcactgcaacctctgcctcccaggttcaagcaatcctcctgtctcagcctcccgagtagctgggattacaggcgcccaccaccatgcccggctaatttttgtatttttattagagatggggtttcaccatgctggccaggctggtctcaaactcctgaccttgtgatccaccccctcagtctcccaaagtgttgggattacaggcatgagccactgcacctggcaacataaaatgtttttcttttagtacatcatggtcacgaagatctggaaaacgttgctctaggacccaatgcctttgagcacatgaatgtctttgaactgagcctggcccatcatagatattcagtttgtgaaagcaacaatctccatttcacagacaaaaacggagacttagtaaactgaaatacccacatcacagtgttagtgatcagtaaagcagggatttgaacctcaggtgcaggctgcagctcctacatacttaaccaacatgccaccctattttgctgctataaacactggggtaatactggcatccaccctggactatttttccaattggaagaaatagtaagtgaccactccagaaacatttaaatgcattgtgaaggttaattacctctcaagttgctcgtctcaagccacttctttacgatatgtgagttgcatgaaggagcagactgccatgttcattgttctccatggtgactagctccctgtttggcacaatgtagctactcaatagatgtttgttgaatgaataagtgatccaggcaaattgaaagtttccaggcagaggatcagttaaaatccaaagctgccttcagtaaagtggtgagtccagaacactattccatctggctacttcctgctccaaatgactgagttcttcaaaatgtgcaatgtgctgagaattggggagccaagactgggatgttggtgaggtaaggagggggagtacaaggggtaaagtcccagcaaaacaagggctgcagtgttatgcaattttttagtccatataagtgacacctccctggagttgtatactatacaatcaaagcactccttcccagctgtggggaggagagttagatcatgcatttgtcccatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagtaagtgaaaagtgtgtgtgcgttgtatatgtgtgtatgcacgtgtatgtgtgaatgtgtgggggaagcaatgtagcacctgtcagaggtgatctcaatcctcctatcgcacttgagacttgcattgtcttcattctaagtccatttcttagactcaatatgcacaggactgacttagaaattttgctaaagtgcatattctggttcagcagatctgcagtaggacctgagatgctgaatttttaacaagcttccaggcgatgctcatactggggtccctggagtacacattgaaaagcaaggggctagaacatctctaaggcctgcaggccctttattggaagtcagaaacatactctatcacataggagatttgaacccatgcaggaggatccaaacaccttccctttcaactttaagaggtcattccattgggttgagatttgctgtcaccccactttcattttctccctggagtacgttggggcacgatgaatactattgcggtgtcctggttaaaagcacatattttgtggtcctgccatctgcgtttttatcctggttctacttcttaccaaaggagtaaggggcttaatccctctgaacctcagtctcctcatctttaaaataaggatacataaaaaactgacctcacgaggcccttgggaagtattcaacaagatagtgagtgaaaagtgcacatcctattgcctggcatatagtaattgcttaataaacaacagcttctttttttttttaatggttatttttattacggaggaacaaagtacaactgcccagccaggtggagttggaggactccgcagagaggaggcgacactgagcagggtcctgatgaagatttcaccagccagggaagcagaaaacataaaatgtgcaaagaaagggaggggcaacaggttcaccgtaaatcctaccaaagtataggaattctgcgcattacttttctgaatgtggctattttaaaagaagacagcttgaaagcaatgcttaacacaaaaaatgaatggtggagctgggcgcgattgcacgtgcctgtggtcccaactttttgggaagctgaggcagggtgcggtggtggcttgaactcagggagtagaacgcttgaacccaggaattggaggctatggtgagctatgatcgcactactgcactccagcctgggcgacagagcaagacccctctccaaaaaaataaataaagttaaaaaatacaatgaaataaacacagaatgaacggtggaggcttgacatcatcagaggagttttgtttctttgcttctttccttgttttggagggagccctctagggaataagtcttaaaaataatgagttccctggagaatgagggaaggatctctgggtggccatgggcccagctgcccaaaccctgaagctgggcttttctgtccacaggatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgccaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacaggtcagccggagtctccccacagtcctcatcccaggcctggaaaggcactgcagaggacgggggtgcgtccttattgattgtctgtctgtccctgtgaccctgcagaccccagctccgtggaggggacgtgtgaggagtgcagtatagacgaggactgcaaatcgaataatggcagatggcactgccagtgcaaacaggacttcaacatcactggtgaggccagtggggaggaagcgggttgttgagaaacctgtcactgcctgggggagggacacattcctcccctgtgagattggggccatatgggtatgacgcaggggatatatatccaacctgagtgaaaacagaagatccactaatacccattaaagccggcaagaggctctctgaggctccctgagtctccctttagttgacttcaaagctgccaaagatttggggacctcctcgcacccagccttctttctgaggcccacaccacagtgggcacccacgttgctgccatctgggagccaaagaccatctgagccctattcctgcagcaccagaacacaagcccggcccggtgagcagtccaccaatcagctcaggcctgatgaccagtccaccaatcagctcagtactccgggccaggcacaagcctcagatttctcataggtacaattattgaagatgaaaatagtattttcagacttcagtcatgattttagttacatccaagtgccaactttacaattggcaccctggttcacttgctttatccaagtgttacctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaagagaaagaaggaaggaaagaaagaaagaaagagagaaagggagggagggaaggaaggaaggaaggaaggaaagaaaggaagaaaggaagaaagaaagaaagagaaagaaagaaagaaagaaagaaagaaaaaaaaagaaaagaaaggaaggaaggaagaaaggaagaaagaaggaaagaagaaagaaagaaagaaagaaaaagaaagatttaatgttggccgggcatggtggctcacgcctgtaatcccagcactttggggggccgaggcgggtggataacttgaggtcaggagtttgagaccagcctggccaacacagagaaaccccttctctactaaaaatacaaaaatttgctggacctgttggtgggcacctgtaatcccagctactcgggaggctgaggcaggagaatcacttgaacccaggaagcagaggttgcagtgagccgagattgcaccactgcactccagcctgggtgacagagtgagactctgtcccaaaacaaacaaacaaaaagaaataattcatgtcattttccaaggatggcatttgaaattccattgatggtgacttggcatatggttttcagttttcaagagaggaagcacggggtgctgaaaacagtctagtcttgtgagatgtcacatattgtgggcaatccctcagtgactctgttactatgaatccctgtcttcttgtctgggaagcagggatgtggcagcgccacttgttagggtcactgaaggaactaatgctatgactcaggaggggtattccactcggggtctggcacatgacatatgcgcatgaatggtcattgctgttgtaacttttttttctaatttataaagaaaagatgattaattggctcgttgttcaggctgcacagggagtttttaactgttgtgggattttttttttttttttgagatggaatctccctgtcgccgaggctaaagtgcagtggcacgatcttggctcattgcaagctctgcctcccgggttcaagcgattctcctgtctcagcctcccgagtagttgggattacaggcacccaccaccacgcccggctactttttgtatttttagtagagacagggtttcaccatattggacaggctggtctcgaactcctgacctcaggtgatccgcctgcctcggcctcccaaagtgctgggattacaagcgtgagctaatgcgcccggccacaggcagctttttatcaaggagactaggagagcggctcacaagtagccagacatgagaccagcagatttagctttgaagtcctactcagattctcatgcccctttctctcatccccaccccccctccacccccattccctgcaacagaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcaggtgtggccagagagggtccctagggcccctagatggttctaaccccaaaccccttaaccatgagcttccctgtcaactgccacccacagggagctgggagtgagggctgggaatcagggttgcccaatggaagagccaggaattctggagcccaggttcaaatctagactttgtcataaatgatggttatgccctggccagtgggggacagagtcaaagcactgcctggttcaagccccagctctgtcacttactagttgtatgagcttgagtgagttattaagcctggctttgggaaattgatagtccctctctaggtgtcaatattttcatctgtgaaatgggtttaatagtactctaagaattaaatgatatgggaggatcgcttgagcccaggaatttgaggctgcttagagctatgattgtgatgtgaatcagattcaaccattaaactgatgtagatgattcagatgtgaatcaaatattaaagtctctacttttcaaagaggcagggtggttgtgccagagagcaggaatggtctcagtccagactgctatggaatgctgggcaaatcatatttcatatttggacctcaacttctttccttctctgtgaatgaaaggaatttgattaaagaggattttaaaaattacgctccttgcaagtgtcttggtaggggccaagggaggtgccctggcagagtgcctacaggggtaaactattcatactgggtgccacgtagtattttattttattttttttaaaaggaatctgttgctaaataaaattgaaaatcttcaaataggatgaatcacaggccaatgatggaaaattatagttgtaataagaaataagatttattgattatttatttatttatttatttatttattgagacggagtctcgtactgtcgcccaggctggagttcaatggcatgatcttggctcacttcaacctccgcctcccaggttccagtgattctcctgcctcagcctcccaagcagctaggattataggtgcccaccaccacacccagctaagttttgtatttttagtagaggcggggtttcaccatgttggccaggctggtctcaaactcctgacctcaggcaatccacccacctcggcctcccaaagtgctgggattataggtgtgagccaccgtgccctgccaagaactaagatttattgagagcttactatatctcaggcattatagccagtgttctgcctggaacatctcatcaaactcttacagcagccctaggagataaaggtatcattattattactattcccattatactgatgtggaaattgaggctcacagaagtttgagtgacttacccaaagctgtaaagtctagcaagtgatagagctgggattcagacatcaggtccagagcctccacttgaccatgaccttcccttcgaagcttgcccatggttttctgctctcttggccagccagactcaggaaaggatgctgggcactgatgagggtgcacagctgacttggaggaagaagagtgctcattgcaagctgttggctggaacctcacctggcctagcagtgtcctggagcaatgtggccccgtcctcggcctggtaggctctggggaacaacaagtgtgcccacatctctctgttttatggttttgttttgttacgaatccaggtctcactctgtcacccaggctggagtgcagtggcacaatcatagctcaatgcagcctcaaattcctggtctcaagcaatcctcccacctcagtctcccaggtggctaggactacagacacatgccaccacaccaccctgggctatttttaaaaatatttttatagagacagggtcttgttacatggaccaggctagtcttaaactcctggcctcaaatgatcctcctgcgtatgcctcctaaagtattgggattacaggcgtgagccacagcacctggtccctctctctgtctcgagttagacatctcaccccagtcttcactgataactcagttctcatctgtaaaatggacttccacatttcggagtatttctcatgtgccttatttcatgaggcatcagccttacaatgtcctttgttggatcatccagtgaagttcacatcagtgtggctgttttcagtgtggttaaaaataactcatttataaacctcaatcttctgatatagatgttagtacatcacgatggaggccaggacgcaagttgtaggcctcatcatagctcaataccttttaacctgttctagattgagaccaaagaaggaatccaggtgttcctgtcaataatttgtttttttgccatcttgaaagctacaggggtagcaaagcctatagcagtagcaagtgagggactggatgtgttacttgagatgtgattgatccatagaccagcagcatcagcagcatccaggcacttgtcagaaatgcaggaccttgagccccaccccaatactcaccaaatcagagcctgcattttatctagatcccaagttgacctgcgtgtacttattgcggtttgcaaagcaacagttggtgggttccactcttattgctggataaaaatgcaaataactgcaagggactgcctaggaatgcaaatcagagaaggtggcctatctgcagatgttctcagcccggtcctctcaccaacccttctcccctggcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacaggtaaggcaaaggttcctacatgggaactcatgggtagaattcagagggggtctttggacttggatggaggaaaattgcatcttttttttttttttttttgacagagtcttgctctgtcgccaaggttggagtgcaatggtgtgacctcggctcactgcaacctccgcctcctgggttcaagtgattcttctgcctcagcctcccaagtagctgggattacaggcagaggccagcaggcctggctaatttttgtatttttagtagagatggggtttcaccatgttgaccaggctggtcttgaactcctgacctcaagtgatccacccccttggcctcccaaagtgctgggattacaggtgtgagccaccacgcctggctgaaaaattgcatctttatattcattaccctttagctgaaccttagcattcccatccattataaatacaggcaacaaactacagaaatattagcaggtcgtgtgaagccatttatagtcatcagtannnnnnnnnnnnnnnnnnnnnnnnnnnnnnnnnnnnnnnnnnnnnnnnnnatatatatatatatacacacacacacatatatatacacacacacacacaaagatataatgcatttttgtatttcaaatgtctttttttttggtcgtttgatttggtttggtttttttgagacagggtctcattctgtcacccaggccggaatacagtgacttgatcatagctcacggcagcctcaaccacccaggctcaagcgatcctccagctctagcctcatgagtagctgggactacaggcacacaccaccatacacagctagcaaatgtttttaatattttgagaatggtgcttcaatttaattgatttcctttataatcttttaaatattttattttaggcatttaaaagtattatttctgaggagggatgtacaagcttcaccagagagctgagtagggtttataattcaaaaaatggtaagaaacttgatggaaaggcttgcccagggcagcaggcagcccagcacctgggggaggagtaagacatgggcatggttagccaagggccaattgaaactaggacacaagtgtgctaccttttactcaagaggcactagatgactatgaaccttaccatgagacggtgattcactttctcgttcataagttgaaaagatattttggaagcttgctgtgtgtcgggctctgtggatttcacagtaaatagaaggaacaaaaacctctgccctcacacagcttatattctaaagggggagggccaactattaaatgaaagtgaaatatatagtatgttaatgacaaagaggttgtagaagaaacaaagcaggagaagaaagacatttgcaattttaattgcattgtcagaaaaagcattcctgagagacagtggtctgtttctgcctggttacaccaagggaatattttcaggtgagtgccaatgtgatgttcacacgtctttggaatctccctttgcaataaaaataaagcagaagtctgtttcagagcattttgcaattagcagagtctaactcaaacttaatacaactcttttgttgatcttgtcctcattgtatggtcctgttctatttatgcaagtgatacttgtctgccatttgaattcatgacctaaagattcttctagtaagtaaatgtatttcagtaaaaaatacaagtggatttaaagaaaaatagtaagtaaataataatacagatgttgggacacacaggaaaacgctcataaaggtggtatctcaataaagaaaaaaagaactgaaagttggaaactgttggcatgaccttgattggagtatcacagagatttgggttcaaatcttggctttgccatttcttagctttaagaaacaggttagctcatctctctgggtttttctattctcagacgtaaatggggataaataatacctgctatgctgggattttaaaacttgtttttcatgagtataacgggcacgatggctcacgcctgtaatcccagcactttgggaggctgaggcaggcagatcacctgaggtcaggaggtcaagactggcctggccaatacagcaaagcccatctctactaaaaatacaaaaaaattagacgggcatggtggtgggcgcctgtcatcccagctacttgggaggctgaggcaggagaattgcttgaacccaggaggcagaggttgcagtgagccaagatcacaccattgcactccagcttgggcaacaagagtgaaactctacctcaagaaaataaaaataaagcatagcagggaggccgaggcaggtggatcacgaggtcaggagttcgagaccagcctggtcaacatggtgaaaccctgtctgtactaaaaatacaagaattagccaggcatgatggcacacacctgtaatcctagctactcaagaggctgagacaggagaattgcttgaactgggaggcagaggttgcagtgagccaagatcacaccactgcactccagcctgggtggcagagcaagaccccatctaaaaataaaataaaataaaagtacagcagggacattgcggaaaacttggaaagttttgaaaaagaagcaggaaaaaatgtagggtgtgtctataagttgccatctggggtgagtgtgggagctggggtgagaactacccagtgtaggataggtgtcagaacatcacaaggcatgaaaagaggagacaagtcggggagacagtgaaagtgactggaggggacacatgggatgtccaggttggcttgagcacgtggagccctcacaggccatactgtctgcctttcaggagttgagtccacttaacctcagggcttttctcttgccaggcagagtctgcacttttggagccagatctgaattatgggagacacagagctaagagtgaaaaacactcccagaagctcccgtctcagttttgcagtcagtgttcagcctccctccgaaatcaactttgaggaaagagtgcggaatggcagagggggtgcccagtttgcctccccagaaagcctatgggtatcctgacccagcccagcacatgtgggagtctctgcatgctctatttcgggtttctccttctaactgtgtttgggtgcaattgtgtatacgtgcagatgggtgcacacactccaatttcatcagtggctctcggtacccagaggtttccattgttataattataccaggcatattgtagatagcacatagcagctaataatttttgaatgtcattgctgggaaatcaggaagtgctgacttttggatagtttcagctctgcactgatgacagtttcactttagtatcaaatatataaagcacctatggcatgctacacacagttctacgcactttgagaaattaacgaatttaatccttacagctatcttatcacatgggctgcgatcatttcttatgtacagatggagaaattgaggtacacagagattaaataagttgcccaaagtcacacagctgaaaggtgacagagcaatatttgaatccaggaagtctgactccagaatctttatttaaccaaccacattaaatgatgtgtaaccctcccagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctgtgagttgactcccctcccccagcccatctcttgtaaccaaagacatttggccacaaagaaaacaaatcaatatttcttccctgtttccctcttttaccagagggatagaatgagcaataagatgaggtgggcgtggctaggcaggaaacctaagctgcaggggaaatcaggtgggatcagtaaagtgcggcaggctggtaagagctctggcttatctgcaagcttgtgttcaaataacaggagctgacatttttaagcactgtgcccactttatttgtgttagcttttaatgcttcacagcaactctataagggaggtattactggttccctttcctcatgaggagaggggctcagagaacttcagtggcttgcctgagatcatgcatctatctaacaaatggcagagctgggacctgcacgagccccggtatacaggtctcctaacaacttctgcctggggcaagggaaggcacctgtgaggtgggcagtccactccacgtggcagaaccacattcaggctccttcatggagggtgtttttctattgccctctccctgtagacctgctctgggaccagattccgaagtgggagtgtcatagatcaatcccgtgtcctgaacttgggtcccatcacacggaaaggtaagagagccactcgctcctcaacattcctggctgggaaagatttctggagaggaagagggataacagagcctggcaccttggcaccttactgagctctgaagaactgggagcaagtggatcctctggggcaaggtggaatacagactgccttcctttcactattcccattcatacacccattcattggacaaatatgatttgtagatgaatgtaacacaggacacgggggaggccagacaggcaggtaggaatgtagatcatccagacaagtttgcacacacatgaggccacaaacatacattcatatttgtagtagatgtgtgcctactctgtgtctggaggtcttgtgatgagcagaagtagatggccctgctcccatggagcttgtgaatcagtgaagaaggtgccatttgaataatcccctgtagatgtgtaggatctgggtgatccattaagtgcagggtctacaaaatatctcaagcactgatcttaggagtggtttaggaagggtcagaatcttgtggcttccagctgcatgactcctaaaccttaatttctaatcttgtagctaatttcttagttctacaaaggcagtctagcccccaaggcaagaaggaggtttgtttttggaaagggctgttatcgtctttgttttaaactataaactaagttccttccaaattagttcagcctacacccaggaaggaacaagcacagcttaaaagttagaaccaagatggggttggctaggttggctctctttcactgtctcagtcataattttgcaaaggtcatttcaagagtacagcttgggcaaagggcctgtggcaggagggagcctggcctgttaaaggaacccagagaaggccaggggagttgtgtgggatgagctgctgcagaccttgtggagccttgcagttcttgctaagggttgggacctttctcctgaaagcagtgagagcccctgatgggtctgaagtaggggagtaacatgatcagatttgggttttgaagagatcagtctggctgcgaagtgaaaagtagattgaaggggtttctgtcaggatgcttgccaaatctcatgcattctttattcactgatccttctgttttcctccaaaggtgtccaggccacagtctcaagggcttttagcagcttgggtaagttcaggtcctttctgcagtgggacctgttccagaactctcctggggggcttctatctgttaacttgtaatgcttcatagcaactctataaggggaggtgttactagttccgttttctaaataaggagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctctgcttctttgctcctctaactccctgaggtcccagggtgtgctggagggctgggcttgagctctgaagaggcaactgtatctatggaaatgcctggagtgcctggacttagggctgtacacatgcacacatacctatgctgtgtcccaatagtacatatgtgcacacagacacaggcatgcccagataatcacatgagaatgtaggtcatccagacatgtttacccacacacacaaggtcacgtacatgcatttatatttgcatgtacagatgcacagaaagctgcaattgtctgcatgcatatttgtgtgtgcagatgtacacacacttattggaaacctgtacccaaaggatatgaacataccccagatctgtatattgggcacttcctgaagctccaaggctcctctctaacacctttttctagattcattcaataggtgatgaatattcgttgagtaatactatatgccaagaaccatgcttagtgctggggcaaacacaacggccaaacaagaacccccacttctctgcttctttgctttttctgaccacaaaggccagggacaggtggcatttttatggcccatggttttcatggcactgaattgtctaaaaatctaggtgaaaagcaaatctatgcaacagctactggtacctggatccaaggaggttcttacactaacttggctttttttttttttttttttttttgagatggaatctgctctgtcacccaggctggagtgcagtggtgaaatctcagctcactgtaacctctgcctcctgggttcaagcgattcttctgcctcagcctgcccagtagctggaactacaggcgtgcaccaccacgcccggctaatttttgtattttccagtagagatggggtttctccgtgtggccaggctggtcttgaactcttgacctcaggagatctgcctgccttggcctcccaaaattctggggttaaagatgtgagccaccccacccggctaaccgggcatttgacctgaactagttcagcccagtgctggtgagctcagagatggagagtcacagcactcctaagaggcttgctctctgtgactatcccccaaggtctctaaggatggttggatagattgggcacttcacaagaatgccctttgcccttttgaggaggtaccaagcctagtgccggaggaaagattatctttttcaaatcggtccacctttttcagggcagataaggaggaagcttcctttttctaggagagcagcccagagagggtgtcctcttctgattggtcagcctagacgaggcagcttatgttaatttgcacaaaagtacagcagtactagcagttgccctgtcactgttttcttttcagggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcagtctttgaagtcatccattcattcaacaagtatttactgaactctaccatgtaggcactatgtatggtgctaaggatcctacggtgggaaaaaataaccccccacactgtcctcatggagttcacagtctgctcagtgagactgggttctgctgtgtgaccttagataggatacacaatgtctctgagcttcatctatttattcattcgtatttgctgagcatctactatgtgctagctgccggggatatagcagtgaacaagccagacacaatccctgccctccttggagtttcttgtctggtaggagagagggaacttgaacaagtaattctaagtaggtcaggcatttcagaaatgagagcataggccaggtgcagtggctcgcacctgtaatcctagcactttggaaggccgagtaggcggtggggatcgcttgagcccaggagtttggatcagcctgggcagcatagcaagaccccgcccctacaaaaaaaattttaaaaattagctgggcatggtgtcacgtgcctgtagtcccagctactcaggaggctgaggagagagaatctcttgaccctgggaggtcgaggctgcagtgagctgagattgtgccaatgcaccctagtctgagtgacagagcaaaactctgtcatcagaaaaaaaaaggaaaaataaataatggggtaccagagcctgctggttctgtatcatggagacaatagtgacgtcctcagagggttccttcagtgttccagaaacatttatctgagcatgtcatatgtgccaggcactgttctaggtgctgggaaacactgatgaataagacagacaattaaatactgatgagtaagtccttgcttccaggagtctcccagtccttaggggtaataaggagtaagcaactcaaggtcaggtgcctgcaatgtccgcaggactccctccaatcattgaacatctccctcacaatccagaagattccctggaaaaccaacttccagggatacatcaacagtggagaagagatcaatgatccccattggtaggggatgctttgtggggtatgggggtctccagcatggggcagctggttccaggagaccccgatgccccacgggtctctggacgtctgcgccaagtggttagaagaaagccaatttcgatgggaactgtctgctctgctaccagctgcttccctggactccatctgtggcttttcaggagaggccaaggccctccttagtacattattagaactttctgatcccagggaaatccacacatgtgtatcagcaaatgggggctgctaggacagtgtgtcttaagtcaagggcctcttatcacacagacatgcacagaaaacattgacataagagctttgtggaggaagactatgggctgatcccagcccctgtccactgtcaggccatggtcagtctgtggctgatggcgtacacatccatctgtgcttgcactccaatacaatagaacataaaggaaaaatctgggccaagatcagtaaagataaggaccaaagacaagagctgggataaaaaaaaaaagcacaacagaattactcctgcagtccctcggttctttttctttgcctttcttgttttctatcgattattcagctcagtattttcaacagatatttggggcataaattcaataccaggcaattttacatgtaccatggaaacagcaaataaccaaaagagagcccttgctggtagagagcttacatttaaaaggcagatacatttaaacaacaactatgtgcaatgtgatagatggcgactagttctgagggggatgaaaaaacaaggatgagggatagagaaatgtgggtgttatttgacataaaatgatcagagaaagtccctctgctaagcagaggctaaaagaagtaaaagagtgaaccaggggcatatctgaagaatagcattgcaggcagtcagaatagcaggtgcaaagtcctgaggtaggatcttgtgtctttcc

SEQ ID NO: 14408 - DNA, 5649 bp, Human
tcaactggaactggaactgaaatcacatactgacttcagcaacgtgaaacattggccggtcgcggtggctcacgcctgtaatcccagcactttgggaggccgaggcgggcggatcacgaggtcaggagattgagaccatcctggctaacacggtgaaaccccgtctctattaaaaacacaaaaaaattagccgggcgtggtggcgggcgcctgtggtcccagctactcaggaggctgaggcaggagaatagagtgaacccgggaggcggagcgtgcagtgagccgagatagcgccactgcagtccagcctgggcaaaagagcgagactccatctcaaaaaaaagaaaaaagaaaaaaaaaagaaatgtgaaacaaaggccgggcgtggtggcactttgggaggccgaggtgggcggatcacctgaggtcaggagtttgagaccagcctggccaacaggggttaaaaatacaaaaattagccgggcatggtggtgcatgcctgtagacccaactactcaggaggctgaggcaggagaattgcttgaaccggggaggcggaggttgcagtgagctgagattgtgccactgcactccaccttaggcaacagagggagtctgaaaaaaaggaagagaaaagaaagagagagagagagaaagagagagaggtagggaggaaggaaggtgggaagggagggaagggggggaagggagggaagggaggaaaggaagggaaggaaaggaaagaaaggaaagaaaagatagaaaagaaaggtggctcgtgcctgtaatcccagcactttggggagctgaggcaggcggatcacttgaggccatgagttcgagatcagcctggccaacatggccaaaccctgtctctactaaaaatacaaaaattagccgggcatggtgtctttgcacgcctataatcccagctatcccttgaacctaggagttggaagtggcagtgagctgcagattgcgccactgcactccagcctgggggacaagagcgagactccgtctcaaaaaaaaaaaaaaaaaaagtgaaacaaaaagtgtgccttaaaatagatgaagtactgtattattattattattaaagggctggagccagaacaagttagcattttgtgcctcgagattcaaatcccaggtctaccatttattccttgggtgacatttttttggggggaggggctggaggacagggtctcactctgtcgcctagactggagtgaagtggcgcgatctcggctcaccgcaacctccgcctaccgcgttcaagcaattctcctgcttcaggctcccgagtagatgggactacaggcgcgcgccactaccgcccggctaatccttgcgtcactttaagcaagacacttgatctctctgtgcctcagtttcctcacccgcagaatgaatatcaatagttcctgctacacaaaactgtttgggctattaaatatgtgaatactcagaaagtacctggcacaaagtagccttatcattgctattatttagaacaaagttattgtttccaggtttggaggtgggctggcggagggaggagaagacgcactaggttgcctttcagaaaaggggtccaggccttatcctgcctcccaggtggactcggcccgggatcccgagccccgccccctccaggccccgccccgccccgccctcgctggccgagactctgtgctactctcgcgcgctttgaaagtgcgcgagctccgaccgagacctgggccggcggttggtcggccgaaaccatctgctacgttacgtggggggaggtcagctcctatacagccacacttttttcaatcttcagcttttcaggcctaggtcctggttttattttagctttcagagcttctctgtaggctcgaatttccaggaggcagcccgagtccctggggagagggtcatcgtggctctcgtcggtgccttccacctctggacaggcaaccggtgggagaggacgccggtgggcggggggaggaggcggccctagcgccattttgtgggagcgaagcggtggctgggctgcgcttgggtccgtcgctgcttcggtgtccctgtcgggcttcccagcagcggcctagcgggtgagtcgcggagccttctcactgaggacgccgtaggtgcctcggcttctgcattggggcggcccgaggcagacgcagcggcttcggaccctgccccgggaagtcagccgtgagaccgggcctagtcctgcccgagcgggctcgcgcgggagcgtcgttaggtcctggcacggggaggccggtggcgccgaaacggggggccgggcccgcggtgccgcgtagcctgaggcggaggttggccccggacccggacagtgccggagccttcggtactttgtacttcgagggacgctgccagcttgggcctggtgctcctgcgccccaccccgggccgcgccgagaaactcctccctcggctggcacgcgcgggcttctgggaggcgacggccggcaccgccaggacctgtcgccgcgggccttggggctcgggctcgcagagcccccggaagccccaaaatgaggaacagagggaaacttttctcctgttctttacacctggttcactgcccatattcagtcttcaggttcagctgatggatcgcttgcttaggaaaatcgactgggacctatcacgcccatgcctcagccagttaggctcctcctctgccttcaggattacttaacgactaacccgattgtcataaaatagctactgtttattgttcccttgcataccctagcttgtaaccagcaagccacgttggactcagttacagtttcagtacctgacgcatcataagccttcagggaaagttttttgaatgaatgaactggcgaggcatcacattttgataggaaatcactacccttaccttcacctcgtcatttttcagggataaccaatgcatatacgaatccagacaagcatttttctggaagtcagaactctgacatggtttgggtattatcattataaggaaacagttattctgacatgaatgttgttcattcatatctcttttctctttaggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggtttgttaccatttggtttttgtaatcatgctgaagtgtgttcaggtgtgtgtctcatccatggatcttagcctcttttggtggcagaatgtctcctgaaacttaagtatttccttgaacttcagtgttagacaagtttggaagaccacgagtctaaatttatggaaactggggattgtagatcattttaaaagagaaaacaatgtatttaaaaaatatctgaataagctttgccaagttgatgataaatttcaggaatcactaagaatgttttgtacataaatcattgttgtaaatagattcttctgaagtgcttcagtgtttggatttgatcattgtccttttggtgttacatcattcattcagcaaatctgagttcattttttcccttaaatgaacaaacagttggagtagccaaatcttgaattagtgcagttccaattacaatttcgaggttctggtcttatccttctctctgcctcttatcaatgatgttctaaatctaagaaaaggaagcatgaagtttaagaagtgtgccaaggaaatacctaatttcagcattttgaagtagtgtgctgttagtagtcgatctgtctgtgtgttccttttattataacttggtattgcaacaaagtccatcaaatttggtcagtatgcaagacacccttttacatgtctaggaaaactttagggctaggcacggtgactcatgcctgtaatcccagcactttgggaggccgaggcaggtggatcacctgagatcaggagtttgagatgagcctggccaacatgatgaaaccccatctctatcaaaaacacaaaatctctggatgtggtggtgggtgcctgtaatactagctactcaggaggcagacgcaggagaatcgcttgaaccgggaggcagaggttgcagtgagcagagattgtgccattgcactccagcctgggcaacaagagcgaaactccgtctcaaaacaaaaaaaacgaaaacaaaaattggcgtggtggcgggggcctgtagtcccagctagtctggaggctgaggcaggagaatcgcttgaacctgggaggcggagattactttaagctgaggtcgcgccgctacactccaacctgtgacagagcaagacttcgtctcaaaaaaaaaaaaaattgataatgtaaactcggggtttttagtatgctgtttcttcagccagtgggtatagattaatatttactcaaatttaaaatgtcaggctcggtgcaatggctcacacctgtaatcccagcactttgggaggctgaggcaagcagatcacctgaggtccgaagttcaagaccaccctagccaacatggtgaaaccccgtctctactaaaaattcaaaaattagccaggcgtggtggttcgcgcctgtagtctcagttatttgggaggctgaggcaggagaattgcttgaaccgggaggtggagattgcagtaagctgagatcgtgccactgctctctggcctggcagcagagcgagacaccgtctcaaaaaaaattttttaaatgtcatttaatttatctccccaggctggacatggtggctcacatctgtaatcccagctactcgggaggctgaggcaggagaatcacttgaacccgggaggcagaggttgcagagaggggagattgcgccactgcactccagcctaggtgacagaatgagactccgtctcaaaaaaaaaaaattatctccccttctcttctaaataacctaaggttgaggttatttggggggtttttttgttgttgtttgtttgtttgttttttgagacagtctcactctgtcgcccaggctggagtgcagtggcacgatcttggctcactgcaacctccgcctcccaggttcaagcaattctctgcctcagcctcatgagtagctgggattacaggtgcctgccaccacgcctggctaatttttgtatttttatttatttatttttatttgtttatttattttttagacgaagtctcgcccttgtcgcccaggctggagtgcagtggcacgatcttggctcactgcaacctccgcctcttgggttcaagcgattctcctgcctcagcctcccaagtagctgggattacaggcacctgccaccacgcccggctaattttttctttatttttagtatagacggcgtttcaccatcttggccaggctggtcttgaactcctgaccttgtgatccacctgcctcagactcccaaagtgctgggattacaagtgtgagccaccgcgcccagccagttatgtttttttaagtaagccaaacttttggtttctttttcttt

SEQ ID NO: 14409 - DNA, 40897 bp, Human; identical to SEQ ID NO: 13910

SEQ ID NO: 14410 - DNA, 40897 bp, Human; identical to SEQ ID NO: 13910

SEQ ID NO: 14411 - DNA, 40897 bp, Human; identical to SEQ ID NO: 13910

SEQ ID NO: 14412 - DNA, 40897 bp, Human; identical to SEQ ID NO: 13910

SEQ ID NO: 14413 - DNA, 135476 bp, Human; identical to SEQ ID NO: 12611
  misc_feature (1)...(135476): n = A,T,C or G

SEQ ID NO: 14414 - DNA, 14742 bp, Human
  misc_feature (1)...(14742): n = A,T,C or G
gtattagccgggtgtggttgcatgccagtggtcccagctactcaggaggctgaggttggaggcttgcttgagcctgggaggttgaggctgcattgccatgatcgtgccactgcattccagcctgggcagctgagccagaccctgtctcaaaataataataattctgttaaaaacgtaaaacaggccgggcgcggtggctcacacctgtaatcccagcactttgagaggctgaagtgggtggatcacaaggtcaggagttgagaccagcctgaccaacatggtgaaaccctgtctctactaaaaatacaaaaattagccagggtgtggtagcgcacgcctataatcccagctactcaggaggttgaggccaggagaatcgcttgaacctgggaggggaggttgcagtgagccgagatcgtgccattgcactccagcccgggcaacagagcaagactgtctctcaaaaaaaaaaaaaaacaacaacaacaaactccaaacaggccgggcatggggctcgcacctataatcccagtactttgggaggccgaggcagggggatcacgaggtcaagatatcgagaccagcctagccaacacggtgaaaccacatctctactaaaaacaaaaactagctgggtatagtggcatgggcctatagtcccagctactcgggaggctgaggcaggagaatcgccttaacccaggaggcagaggttgcagtgagccaagatcatgccactgcactccagcctgggtgacagagtgaaaactgtgtctcaaaaaaaaccaaccaaacaaacaaaacagtcaaacatacacaaaagtagaaacaagtgtaatgaaactctatgtatacatcaggagctttaataaaaattactagttcatagcacatcttgtttcatgtatatttccactttccacgtaatctgaaacattcaagaaatcaggtatcatctgcaaatatttgtggctctaaaaagggtcttttaaagaaataaaattacagtataatgacaacaaaatttacaattctgcaatataaaatgtcactgatcatattatcgaaattgctttatagttgttctccagttcatttgaattaagattcagaggtccacaaaattgcgttagttaaaagtttaggaattgcgttaaaaaaattttttttcaaagattttttttcaaaatctttacgtgtgtccatggtcaaatgtacaaaccaaggtacgtccgctagttccattttagaggcggcctcccagagaggggctgtgtctaacttgctggcttctcttccactctgcactgcccgcccttccccgtggctggcactctggactttccccaggtcgcgctcgcgcctggctcccttcgggagaactcggagaaatgtcttcccgccgccctgactctctccttcccccacttcctgcctgggcccagcgcgcgggccacggggccgcacctgcaggcacgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggtgagccgccgcgcgggcgccccggccccgccactccagtcccggccgccccccccaggtccctttccgccgccccggtcgctcggagacggacgcagacctacgagcgcctcttcccttccctcccttcagccgcgctcggcccgcgggtccccgagctcccgcctaggcagcgctagcttggcgggccgggggagcagcccccaccccaccttgccgtcgccctcgctctcgccctcagggccccggaagcccgccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggaacgtcgccgtcaccttgtctcggggcatcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggtaagtctagagcatgaaagtccgcgggcccggccgggtggactttggtttgagagtggaactaagtgagtaatgggggcggcgcggccagacgcgctcccagcctcctggcgagagtgctgcccggtttcccgggggcacgggagtgtgtctaggaggggaggccaggatccttcctcgagtcctgtcctgaacaaaagaaaacgaggtgggtggtgcttgaacggccctgtttactctgcagatagccgaactggtaggactccggcgcgccctatttatcttgattggctctgcctgaaggcaagcgttaatcccgtccaacctgtatcactgcgaagagctcgttcgggagcgctttttggaaatgcagattcttagcccccacccagatctgttttagggttggtgttttaattatctaggtggcccccgtgcaagctcgatctgaaaacctccgggtccagtcacctgggggagctgagcagccctccccgcccccagcgctttcttggcgctgcggacggggagaccagactcttcctctgcgtgcgttggcggtgcgcagtggccgtggtctacaggcttacagcggctggtccattggggtaaatgggtgtacgtgggtctggttgccagcttgtgcatgtccccagagacgcctcagggtgttggtctgtggatcacgcagggataaacaagggcataagtggatcagatcattaagatgactgggttccaccctttagatccttgaacaagtcggattgttgaagccttttgaaaacctgattccagagtacttgaaactgtttcacccctgaataggtttcctaataaatgtaatgctttccatttgtacacccccccaatagtgtcttaagtaataatcactggaagtttgcaagacaaggcagatttgattatcttcatgttaagacaacaggttcagcataattagctggttttactaattccacatttccaaaactcaagcagcttagttctcagaattccatagccctcagcccgtgtcctagtcctttggggcagcgtttttactgggatgttggtgatctagtgattatgatgtatgttctagtgaagcatatttcaaagaagttacccaataaaactgaaagtgtcttttggatgtgtctccacactgcttacagaggggttcctataaatcagactgaacaatttctagcaagcacccttgctccttgcccatgctatcccagtgaaagaggggtcttaaggtcaagtcccctgtggttgtcacttctccccccacccatctccctcccaagtgccctgcccccgatatttaaatttcctcccagcacttagggtcctcagtgtacaaacttagaattgggcagaggcgggcggatcacctgaggtcaggagtttgggaccagcctggccaacatattgaaatcccatttctactaaaaatacaaaaattcgctgggtggggtggtgcacgcctgtaataccaggtactgaggcaggagaatctcatcaagagtaaatctcatcaagatcaataaggcgtttcccttttgttgtgctctgtattgccctgtgaaaagataatacttccaaaatgctgttaggtggatggggtgtgagatttaatttaaacccacgggctatataaagggcttcccagctgtttctgtccttacctggagttctgatcccagagccagtgcctaggatctgagaccacacagccaatatcgctctgttttttttttaggacatttcattaccatccagaagtgtctcccactgaaggcatccgtggttgtttttaaggtaagctattttaagaagagccccttttcagctgcagtatttatatttgttatactcaaatttgtttagcagcctggagtgaaaaaagttttgtccctaacattaaccttgagcaggacaccacagggctcttttcagcttgagttttagttaatgaaaagccttaggacttctgagaaatggaacagaaaaccaattctggagtaaaaataagcagtaagtgttttaagtgtacacatgtgttttggaaaggaatggtctcttcgccttgccttcagagaggaagtaattttgcttctgaaacatttcctgatgcaaaacacttatgacatgtaaaagattaggcattttaagtaattcttctatgaaatgtttttattttttatgctgcttgtatgtctttttcagcctagccaggccactgccttcttgaggaaggtgttgacccccctacacatgggcaacagttaatcctggctaatcttggaccagctgggtcaagtctgtgctgaggatggggtcatggtggccaacaaaacaggcacaagtttctccccagtaggctcctattgtgggtttaagacccctttaacaacacaagagtgctgtggttagtgtagagcatgagacttaatttggataatgagaagacctttgagaaaggtggtgtatttgagcttagaccttaaggattagtgggatttaggtagacagaaggttgaacagagtatatttggggagagaattaaccatgagtgtcaactatgtgcgtcacatccctgaaggggcagagagcttgccacattccaggagaaaaaaggaagtgatgtgagcttaggtagaagagtgttgcaggcaaaagttgcaaggcctgagggaccccattgggcctgtggtccttgttctgaggtcagtgggaaaccactgaggacttggatgcaggacagtaatgagttttaaaagtacacgtgagccgtagatgggattgcagtaaggcctagccactgtgcttggaaaacttttttttttttttgagatggagttttgctcctgttgcctaggctggagtgcagtgacgcgacattggctcaccgcaacctctgcctcccaggttcaagcgattctcctgcctcagccttcctgagtagctgggattataggcatgcgccaccacgcctggctaattttgtatttttagtagaaacggagtttctccatgttggtcaggctggtcttgaactcctgacttcaggtgacctgcccgcctcagcctcccaaagtgctaggattacaggcatgagccactgcgcccggcctatgcttggacttatttaaaagatatatcggtaatctggaattggctgtttgtacatacaggaattagaataggagaaataacaatatgaggtacagaaagaaaatgacaatttgataactcccattacaaagaaaagaattactgagttcataggctgccattcaacgtgttaggaacagggtagagctgtgaggcacctttattgctgaggaaatggaagagttgaataggatttagggatgaggatactgtggagaatgggatcacccaagggagttgagttgattggatttgagggcttgggagaaggtcaaggattactccagtttccttctagagcctctgggtgcaggtaggggcagtcatgttgctattggagtgtgacagaagagagaatgtgaggtttagttgtggcacagaggagaacctgtggagtggagttgtgtctacccgtctaggcttcagggagccgaagactgggggtttgtgtatctcctgaccctggagatgattatggagaccctgggagcaggtgagtccactgagaagaggacttgggcccaagcctgattccctacagttaatggttaaggaaggactcagagactgtctaaggaattaactggaaaaccaacagtaattgccaacaggagtgaaagggagaggatttccaggaaagaatggttaagtaagatgaagataaaaacatttgctctttttcttgccatggagatctgtatagtaggatcatgcagtttttttgtttgtttttgtttttgagacgagtctctgtcgcctaggctggagtgcagtggcacgatctcagctcactgcaacctctgccttccaggtccaagcgattctcctgtcccagcgtctggagtagctgggattactggcgcccgccacgacgcctggctaatttttgtatttttagtagagacggggtttcaccatgttagccaggatggtctcgatctcctgacctcatgatccacctgcctcagcctcccaaagtgctgggattacaggtgtgaggcactgtgcccggccaatttttctgtatttttagtagagacagggtttcactatgttggctaggctggtctggaactcctgacctcaaatgatctgcctgccttggccacccaaagtgctgggattacaggcgtgagccactgcgctcaacctaggtgtccaccactatgctcggctaatttttgtatttttggtagaggcgggatttcaccatgttggtcaggctggtcttgaactcctggctccggttatccaccctccttgacctcctaaagtgctgggattacaggcggtgagccaccacacgtggccttgatcatgcagttttaatggaggggagtggaagtgacagtagaggccttttgacaagattttgctgaacaaatcaacaagtagctagaggcaaagttggcacaggggaggtatgacatgattgggtagaactgagcatgtttaattaccaagtagacagggctcagtggagaaaggggaaaaggaaaaaaagaagaaagcatggctccggggtatgtgaggttggacccagagcagagctgttgttcacgatgtccgctgtaaggggcccactacgtgcttacaaactcctggactctgacttgacttcacaaagtccacttccaagagtaatgtcaaccagctggagaggaggtgagagtctgtaaggctgccccagacatctgaagggctttggacaagcagggtgctggggtaggacagtgggcgatattgagggcccgcttactctatggctgttcactctgattttcttttttttttcttgtgtggtgggtttttttttggagttagtctcgctccgtcacccgggctggagtacaatggtgcgatctccactcactgaaaactccgcttcctgggttcaggtgattctcttgcctcagcctccgtagtggctgggactacaggcgcccaccaccacgtccaggtaattttttttttttttttgagacagagtcttgcactgtcgcccaggctggagtgcagtggtgcgatcttggcttactgcaacctctgcctcccaggttcaagcgatgctcctgcctcagcctcccaagtagctgggactacaggtgcccaccatcacgcccggctagttttttgtatttttagtcgagacagaggttttgtctattggaactcatgatctcaagtggtcccacccacctcggcctcccaaagtgctaggattataggtgggagccactgtgcctggcctcaccctgatttctacagtatttcacaacttgggggcagcattagccaccagagaacatttgggaatgtctggagacattcggttgtcagaactggaggtggagggtgctactggcatctagtgggcagagaccagggatgcagctaaacatcctacagtgcctgggcctgcctccacaacacaaagaactgtctggtccaaaatgtcagtagtcctgaggctgagaaattgtagcttagaggcaccgtttcgcctggctgtgtgcagctgagccactcagtacatccatggagtagtcagatatttgtttggaatcttccagagctctggttttactgggcgcgtacagttaagaagttcattgaatgaattccatgtattgtgaggaaggaatgtaaaatgatacttgctctaagctggattatgaagaatgaggagagaaagaggctgtgtggataaggaagccaaggtctctacaaaggagggggatagcagttgtggtggagggagtaggatgtgattaggtggggtttcctgcagggaatggtgaaatcattggaggtaggagtccaggagaaaatggttagtggattatggcttcatctcccctacccggaacgatggctggacctaaggctaggaacagaactcgagggaggccttcagatacttttcatgagtgaggagcaagaccagggtatggtcaaagacaaaaggacaggcggtgcctagcctgacccagtgttgggaatggaattgcataagaagcccccacctgtaattgagctgtcccagacccattatcccaagagacacaatacaaacttgccctgactctccaaggaggagcttctgaactgttagcacagaattccctccgtggacaggagaggaagaatctgctgtgaccttgctctgccagatcagcatgttgcagtggccatatgcaggggatttagataaggccctggggaggcggagaccattacttttctaaggtggaggctaaaccccagggtttgttgcagacccaaagcacagtttgagaattggggataggatnnnnnnnnnnnnnnnnnnnnttgagaattggggataggattatttatgcccaatcatttgccgttcaggattattttataaaagttgatggagtttatgtacatagtcaataatttgaggtgggcaatgagcaatccaggttaggctccccttgactctcttcccagaggcttccatgttccactctcattagcaagggtgacatcttttagttaggctgtatactttgaaagcccttgcattccaaatcacagttcgtgagtaaatgccgagtgtttggtcttggtgatgtgttcaggatatcacatactgttctgtttcatttgtgccattatgcttgttattgggagaggagacacatcttgttatctttataatctggtgtagacacaggtaaatttgaaagatttacacaattatccttttagacgttgtcaatttgaaatgatgaagcactgtatgataatatgtcattatctgcaatggctacatcaaactttaaaattactaattttccctgaagctagtgcagttgagcatttatttagtatgaatttgcttttccttttcttaaattacacttacctttactttttgtctgttttttaaattgtggggttttcttatggagcttttttccccacatgatgagcccatatttcttgaaaaggccaccagctatatctattatgcttgatgtaaaatgacactttgaaacattcgatttccagctgtgcatggtggctcacgccagtaattccagcactttgggcagctgaggtgggcggatcacctgaggtcaggagttcaagaccaacctcgccaacatggtgaaatcccgtatctcctaaaagtataaaaaattagccgtgcgtggcggctggtgcatgtaatcccagctactcaggaggctgagacaggagaatttcgtgaacccaggaggcggaggttgcagtgagccgagacagcaccactgcactccagcctgggcgacagtgagactcttgtctcaaaaaaaaaaaaaaaaaaaaaaattccatatactcctatgctctttttgagcgtcacccttgacagtgttcatataaaaatacgtctttggccccatgatactgcagtgtttttcttgcttgtgactatgttatagaccctgctgtctaggtcagctgctcctctttctcagaagactgccttccagtgtgtggttggccttactctgagtttggacttcaggtgccatgtaccaccctggtgggaagggcatttctcagccctcttgcgattgccctttcttcccgatgccctcttccagatcttcagcacaaggcagcaattctgctatattttatgtgaacctgtgaatcatctgatctggtttctccatttatttgcagtgcacataactaagtctgctggtgaatttgtctgcttgtctgtatatgtcatcagtttggcctcatacttgactggtatttagtttgaattgacaatttaggagcaaaatcataactccatagacagtggaagccattgctgtcttgtatcctggcaacattactgctgatgagaacactagaaaatcttaccctatgttgtggtttaaaaacagcctgctatgttcccatcccttatttttactcatgaaagtaaaagtatcctaccatagacaagcagatttactaaatttactattttaccaaatgtaaggcgtatagtttaggaggaacaactcaggagctcttataggtgaactgccacatattatcatgacaaatatgtggaataaatataacaaggaaatgcccttgctctaaactgactgaaacttacatttctctgtgttcaaggcaccacattcacatgcatcgtcctgtcttgtaaactcctgatttgtttttcaaactgcctgtgactgataatgtaattttttgagagacctggagttaactcttagctctcaattgtatttggtatatttcttaatgtcttgctacctctctcgtctgtaaaatggggaaaatttctgttgcatactaaataaatttttcttttttttttttccagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttccttctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttttttttggtcacgctcctgatttctgtagggcgcatttgttaattaggttatgacaggatacacattatcaagcttgagacccattttcaaattgctatctaccttggcaacagcaatgttgaaattcaggcagctctatatatagcatacagtattactatcattttaaaccttatgctaaatacaaaccatcaggactttaaaatgtggagtttatttaaaaccattctgtgcaaaaatgctatctaccattgggaattcttcaactttattttcccacttcactagctgtataatgtaacctatatgttatgattttaccaatattaagggtcttcattagtatcttaaagagtaaataaatgctcttggtaaaacccctgagagctgcattaaaaattaggtctgtgaagtcttcagccttttctagcctcattgggcttcagaggctcaccttaggtacagcccttcgttccagtgttctgcatgcttatgttctgcatgcttggatggcctgatgtgagggcagcagcatcaccaggaatggcagggtacagggacgcagaaagaggcactcggaagactggcatgggggaaacctagggagaactgtccttgctgtaaccctgatctgggatctctgcccacccatgggcctaccatgcttcaagtgtcagcactgcatggggaaggagaggcctgtaggtgagggagacccacagaaacaggtggagtttccgctggaaatggggctggaatgccatgaagatgagacctcagatttcgtagagtggtggagattcaaagagtaccttcacaaccctggaagtctatgctagatttaggatgcatgggtggaaagggctccaggggatgggaaagggaatgtgttagatgacctgacatcccaaggtaacaacataacatggacagcaaaacatccccttgctccaggattgttaacttttgttggggagggacaagtctctctctgatgcccaggctggagtctagtggcatgatattggctcactgcagtgtcagcctcccgtgctcaagttatcctcccacctcagcctctcaagtagctgggactggaggcgcacaccgctatgcccggctgatttctgtattttttgtagagatggggtctcactatgttgcccagactggtcttgaactcctcagctcaagtgatctgtattcttcagcctcccaaagttctaagatttcaggcatgcaccatggcacccagccatgcccatttgttgctacacacagccgtgcccatttgttaatactgtccatggctgcccaggtactacagcaggcagagagatgggtagttgtatcagagaccacatggcccacaaaacctaaaatatttactgacactacaggaaatgtttttcaacctgtggccttgggcatgactagggcattccctgcaaggtaaaagtcaagatactgcatcttgttatgttgtagaaccccaaattcaggcttgcgtacctgatgtgtagctgatgccaaacaccaagacaaaggtgcttggagataaaggtttatttgatttggccaaggtgagaaatctg

SEQ ID NO: 14415 - DNA, 9299 bp, Human
  misc_feature (1)...(9299): n = A,T,C or G
gcactccagcctgggcaacaagagcgaaactctgtctcaaaaaaaaaaaaaagaaagaaatgaggtatctcatctaaggcactgcttccgtccattagcacaggtagaaccttaactattagagctctcagggacctcagaggtcatcaagaattgatccttacaggagcttatataactgcatcacttacctgccttcttctggtctttgggaaactcgagattatatttcacattagctggatacttttagatcatgaaaagttgcagggatctaagaggtgagacttcagatccacaaaacctcatttttaccgttcagttcagctgtcaaagctgttaagcatttaatgagatgattgcattgtacttttctgcactcagtgctgccaagtgtgtgttattttatagacctcttttttttgaggcagtggcacgatctcggctcaatgcagcctccacctctcaggttcaggtgattctcctgcctcagccacccgaatagctgggattacaggtgcctgccaccacgcccggctaacttttatattttttagtagagatagggtttcaccatgtttgccaggctggtctcaaactcctgagctcaagagatctgcccacctcggccccccaaagtgctgggattacagttgtgagccaccatgcctggccctattttatagatttttttttttttttttgatggagtctcactctgtcacccaggctggagtgcagtggcgtgatcttgactcactgcaacctcggcctcccgggttcaagcaattctcctgcctcaacctcctgagtagctaggactacaagtgtgcgccaccatacctggctaattattgtatttttagtagagacggggtttcacaatgttagccaacactggtctctaactcctgacttcaggtgatacacccgcctccacctcccaaagtgctgggatgcacttgggaggcataagtcactgtgcccagcctattttatagattttttttttctttttctttttttttttttttttttgagacgaagttttgctcttgttgcccaggctggagtacaatggtgtgatcaccacaacctccgtctcctgggttcaggcgattcttctgcctcagcctcccgagtagctgggattacaggcatgtgccaccacgcccagctaattttctacttttagtagagacagggtttctccatgttggtcaggctggtcttgaactcctgacctcaggtgatccacctgcctcggcctcccaaagtgctgggattacagacatgagccaccgcgcccagctatagatatttttaagttaccttcttcatttcctatatttggattactgccatttaatggcagacttagagtatttatccatgacaaagcttagtagcacttaagtgcagcttgtaagaaattgctgtggttcatcagtagatcaccacctttggtgctcatcagaatcattttgtaaggatttaaaaattttttcggctgggcaccaggtggctcacacctgttatcccagcacttggggaggtggaggcaggaggatctcttgagctcagaagttcaagaccagcttgggcaacatagctagatccctgtctctacaaaaaaaatttaaaaggtagctgcgtggtggcttgcacctatagtcccagctacttgggaggctgaggtgagaggatcacttgagcccaggaggtggaagctgcagtgagccattagtgcaccactctactccagcctgagtgacagagcaagaccctatctcaaaaaaaaaaaaaaaaaaaattcctcattggttattctgagtcaataaatgtgggctaaggcttgatcatctgtatatttaaaaaagaaaaaaagctacaggtgatgctatgaagactgctgctatagggggcctctggaactggagagaaggttttggaaaacttctacatttcttctctcttgtccttcaaccctaatctgacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaagtatgggggacagaggaggaggggactcagtaggtgggtggttgttacatgctactcttctttagattccatgaagctgcttttgcccatcaccttcctagactgccttctgcactatttagtgtaaatgtcaatagcaacttgttttttgtattaacctgtatttaatgtagtacggaagctaaatctcctggggtgaaatttctgtttctttttattgtttgttgggcagggctagggtagggggtgaaatttcataatatattttaaagtcagtgaaaagtgattttgggctgggcacagtggctcatgtctgtaatcccaagagtttgagaccagcctgggcaacaggacaaaaccctgtctctactaaaaatacaaaaattagccaggcatggtggtggctacctgtaataccagctactcaggaggctgaggcaggagaatcgcttgaactcgggaggcggaggttgcagtgagccaagatcacaccactgcacaccagcttgggcgacagaatgagactccatttcaaaaaaaaagaaaaaagtaatttttggatcagagcccctgggcatatatcactcatccttttaccctgaaagtgttttgttttaggaactgataattcttaaatgagtagcctcccactccagtgtacatactgttagctaggagaatgggtctggaggtggagaggacaggagagatacaaattagcatcgttattttggtggattctcagggccctgtgagcctttaaaaggagttaggggaaaatatttggaagtagagggcagctttcttacaaagccagccacttaattatttctgtgcttggtttccattaaatactagatgtttgattgagaagaatagaggccaagcacagtggctcacgcctgtaatccctgcattctgggaggccaaggcagacggatcacttgaggtcaggatttcgagaccagcctgaccaacatggcaaaaccccgtctctactaaaaatacaaaaattagccgggcgtggtggtgtagatctgtaatcccagctactcaggaggctgatgcacgagaattacttgaacccgggaggcggaggttgcagtgagctgagattcgccactgcacgccagcctgggtgacagagcgagactctgtctcaaaaaataaaaaagaagaatagagattacaattagaatagaaataatggttattatccaggtctttaaagaaaagtcagacacaggccaggtgcggtggctcacgcctgtaatcccagcactttggaaggccaaggtgggcggattacgaggtcaggagatcgagaccatcctggctaacacagtgaaaccccgtctctactaaaaaaaatacaaaaaattagccaggcgtggtagtgggtgcccgtagtcccagctacttgggagtctgaggcaggagaatggcgtgaacccgggaggcggagcttgcagtgacccgagatcacgccacgcactccagcctgggtgacagagtgagactccgtctaaaaaataaataaataaaagttagacacagtttagaggtacttgtgctgacctgaattcactgaaatgcttttcctacatcccagtgactgtgaagtgctgaccacactcaccccagacactggccgtatcctgtccaagctacatactgtccaacccaagggcaagatcaccttctgcacgggcatccgcgtggcccatgtgagtcctactgggttccctggacctttcctccctgctctgaggtcctgcctccatcatactcatttctcccctggaatcctgagctaggaccagagcaagagaaagctaacttggagtagaaaggatatgggggatgaatcccagggtagttgagggttgtgaagggaaaaatccctagaattgagaattaaggctgggcgtggtagttcatgcctgtaatcccatcactttgggaggccaggggaggaggattgctgaaggctagcagttcaagaccagcctgggcacatagggagaccctgtttctctaaaaaaaaaaaaaaaaaggccgggcgcggtggctcacacctgtaatcccagcactttgggaggctaacacgggcagatcacctgacgtcacgagttcgagaccaatctggccaacgtggtgaaaccccatctctactgaaaatataaaaattagccagtactaggaaggctgaggcaggataatcgctggaacccgggaggtggaggttgcagtgaactgagatcacgccactgcactccagactgggcgacagagcgagactccatctcaaaaaaaaaaaaagagagaaagagaattaacctcccttctttatgcacagagagtcatagcaaaaagggaggaggtgggggtgttaaatcttgtgtgaacgtgatggtagatggtgtacttcaggtacaaagaaactgtaagaaaaagggaaccgagtgacagaggaaagagctgagtgattcctctggttaactctgagaacttcctctccctttacaagctggctctgaagcaccgacaaggcaagaatcacaagatgcgcatcattgcctttgtgggaagcccagtggaggacaatgagaaggatgtgagtccaagtggcagctggggaatgtggggagcccatgtttgggactgaggtcttccagccctcaggagaacctggcagaggcatcaggctcatcactttggggaaaggtgaatgtggagaattcagtgattctgttggaggaccttggggaggtcaatagatttctgtatgcttttatgcggcgggtcctttccccccctcgagtatggaacagatttcttgatttttctccccttcttcccagctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtggcagagtagtgcagaaatgggaaagaacagggagcaaggcctgaagaagggcatcatgtgttctttcctccccaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggtgagcaaatgttgaccccaggtagagtccaaaggtccctctttgttctcttctggcacacacatcacagagcttctatcaggctggatagtcctagacactaccaatcactcattttccaagacctccttttgccgcctcttccctataatgctgtctgatctctaggggcaccagtgtcagatgctttcttgttcacttctgatgaaaaccgaggcttctcccaagtccttactttttaatcccgtaccactgcttatccctccagcttcttctctgtgtgataaaccagaagctgcccctttatgttcctttcccacaccccaactgactttcccagctccctgtaggagtgagggcaggggagccctgattatgccctgcccttcaccaggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcagggagcaggtgagccagagcctgggtggtgcctaggcagaggttggggtgaggaagtgtaactgaacagactgacctctcttcctcagagtttggccaggcggaatcagcagacattgatgccagctcagctatggacacatctgagccagccaaggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctgggcagttctctaggatgtcttcccaggagggaaaaaagcgggtctgggaaaaagaaaaaggagaactgggtgtcttgagagcaggaaacctcaatgtgatggcatctgtttttctcctcagagctcaattaacagagttctcagcaggcccctctatttggttagtaataactgcattcatgctgtataaaggattttgctgacttgtcctttccttacgtcgaccagaggtgcccagatccccacacagtcagaaggcagggggcctctggcagcggcatgctcctgtccttaacacctgcttacttcctgccgctccataccctcccttgagctcacactgcctgtttgcaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaatattgatggttttgagtgtgagagaggggaggagtccctggcctgaaggagaaccttccttgttgagttctctatgtctctgtttccacctgtctgggcctcctaacgtgctgggattacaggcccaggagccaggtttccatttctaatgaacgaagaccttatttaaaccaccttcttgccaataacttttactctgcactcacacagctgaaccccaagcatggaatgatactcaaccttttcagttttttcatgtggacttctgaggttcagcaagtttaggttatttggccaaggatatttagctaatgaagaggcagaaccaggatcaaaatccaaacttgtctcagacctgtctcgccaggagttgaatcaccaccaaacagtagtttcccattggtcagctgccttcagtgactctgctcagccctgcaagtcagttccttgtagcaactactataccttcctctactccccgatcactctcaacagaagcctgacatctttacagagagtcaaggccgtgaggcaggaagttctggctccctccctcctgccagcacctccctgcatcagttatgctgtctcctgagtctctgctgtcctaaacaccctgctggcgttttcctctcagtgtacatgcataaaatccactctacaagtaaccttaccttgagactttatattatacggtttaaatattattttacaaggaacatctattccctttataattttttttaaagttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtagggtcctgccctacccctctgcactcttgaggtctactcccagaagtaatcaatttaacttctttagctagctcttcctgtgcttacttccttattcccaaagaatgaacttatatggctatttcttaatttttccattttagccattatctatactgtttactatagaatattataatttagttttttttttgttttcgaggcagagtttcgctcttgttgcccaggctagagtgcaatggcacgatctctgctcactgcaacctccgcctcctgggttcaagcgattctcctgccttagcctcccaagtagctgggattacaggcatgtgccaccacacccgtctaatttttttatttttggtagagacggtttcatcatcttggccaggctggtcttgaactcctgacctcgtgatctacctgcctcggcctcctgaagtgctgggattacaacgcctgactaatttttatattttttttgtagagacggggtttcgccaggttacctagactggtcgtgagct

SEQ ID NO: 14416 - DNA, 5597 bp, Human
  misc_feature (1)...(5597): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttaggggaattgtgttcatcataaccatatttaaggacacagaaatctggagttcattcagaggaaggggacgaggaatattttgattcattttttttcgtatgtttgttttgtctttggagatggagtttcactcttgtttcccaggctacagtgcgatggtatgatcttggcgcaccgcaacctccgcctcccaggttcaagcaattctcctgcctcagcctcccggtagctgggattataggcatacaccaccacatctggctcatttggtatttttagtagagacggggtttctccaagttggtcaggctggtctcaaactcccgacctcaggtgctctgcccacctcagcctcccaaagtgctgggattacaggcgtgagccaccgtgcatggtgattcttttttttgagacggagtctcactcttttgcccaggctggagtgcagtggcgcgatctcagctcactgcaagctctgcctcctgggttcacgccattctcctgccccagcctcccgagtacctgggactacaggtgctcaccaccacgtccagctaattttttgtatttttagtagagacagggtttctctatgttggccaagatggtcttgatctcctgacctcatgatccgcacaccttggcctcccaaagtgctggggttacaggtgtgagccaccaaaaaaagcccagcccttttttttaaatttttaaaattatttatttttttgagacagagtttcgctcttattgcccgcgttggagtgcaataatgcaatctcacttcaacctctgcctcccaggttcaagcaattcttctgtctcagcctcccaagtagctgggattatagtcatgtgctaccacgcccggatagtttttgtatttttagtagagacggggtttcaccatgttggtcaggctggtcttgaactcctttccttaggtgatccacccacctcggcctcccaaagtgctgggattacaggcatgagccactgtgcccagccttgattcatttattcattaacaaatatttaatgagtgcctgtaatgtggaaaatgctgtatcaccctgataatatttaggcaatatgagttatagtcactgcccttaaggaggagacatatataccaatagtgcatcgccatggagcagtatcacggagaccaggcaggtaacatgaagtgtgcagccagccagagggatggtggtgaactggagaggagtgcctgaaaggaggaacagttactcagctcagctaattgttcccctgtaagaatgcagacccagggttgcgagattttcttgttgtttaagagcgaccagaaatctctatatttaaatataatttcctaccttactaattttttttttggagatatgatctcactctgctgcctaggctggagtgcaatgtggtgccatctcagctcactgcaacctccacctccctggctcaagcgatccttccacctcagcttcccaagtagctgggattacaggcgtgtgccagcacacccagctgtaggagtgaattgacagggcatttgtagaggagattttggtatctgggaaagcaaataagctcctcatcaaagggtaccttccaactctgaggtactatagagggcccaggtgtacttgagaaatgagcagagaggatgtcaagaaaaaacttataagcagaaaacttacaaaatgggaggtgccagacggccttaggggacttccatagttgtctctggtagttgggcagtgactagatagccaggaagataattgagagatcgtgggacagtactgggatatgggaaaaagggacattctgatcatcccctcatttcttcctttgaccctaaagagacatatgagcggctcgaggctgataaaaagaagcaggttcataagaagcggaagtgccccgggcccataatcacctatcattcagtgacagtgccacttgttggggagccaggccccaaggaagagaacgttgacatagaagggtgagtgaatctcaagaggaaaagagattgtgtgttcagctcatgttctcttggccccattttgcttgcttttctcacacagctctccttaacacttggagatttctttcagattcctaactcccttcagctcaatttctttttctttttttttttttgagacatgatgctgctctgtcacctaggctggaatgcagtggtgcagtctcggctcactgcaacctccacctcctgtgctcaggcgatcctcccaccttagcctcccaagtagctgggagtacagccacacatgctaatttttgtattttttgtagagacggtttcgctgtgttgcccagactcctgggttaaagtaatcgtcccgcttcatcttcctaaaatactgggattacaggtgtgagccaccgcgcccagcccagcttatttctttcttattcctttttcttttagcttctctgttcttctctttcctgtttttccttctagcctagctttcttttcccatcagtcacttagtacgttcctcagaatgttcccaacaccctgcctcctttttctctttcctcatctctctgatttccttctttctttcttttcttttttttttttttttgagatggagtctcgctgctctgtcacccaggctggagtgtaatggcacgatcttggttccatgcaacctccgcctcctggcttcaagtgattctcctgcctcaacctcctgagtagctgtgattacaggcatccgccaccacgcccggctaatttttgtatttttagtagagacagggtttcaccttgttagtcaggctggtctcgaactcctgacctcgtcatctgcctgcctcagcctcccaaagtgctggaattacaggcgtgagccactgcacccagcctgatttccttctttctgtatctgttgtcttctctcctcagctctttgtgtttttccttgtcttttgtcctcagacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctaccctgcttctcccnnnnnnnnnnnnnnnnnnnnnnnnnnnnnnnnnnnnnnnnnnnnnnnnnnnnnnnnnnnnnnnnnnnnnttgggagcaagaagtatttgaatacctgcatatatttgggtctttattcgatagcatttattatgagctgtcctttctaaattgtattcattcctccaactaaattataaacatctgaaaattgcacaccaaaacacatccttgtattgaccttcctatcactttacactcactgttttgaatacagcaggcaccaaataaggaggaactggctgattctagtcgaactcatatgtctcagactggggcttgtatgaagggaagtggaagagatgccatggctgttaatgaccactagaggctctcagggctgggcagggtatgggggctgtgtatatgtgatctcccactaccccccacctggccagagctaaaataataaaatgctgagctcactgttcccccaccctctcccccggcaccgggctcctcctgctgctgggacagtgctctagtagaacagacagacctactgacacaggggaggtgagaagggaggtgaccaccaggactggtaggtggggaagacagggggcttatggatgagagcccggtgggagatgggaggagaagagtggctcctatggggaatgatgtggagtgtgtccctgtctctgtcactcagtgtatatttctgccactgtgccgtcctaccccttaactgtgtatagtttacattgtcgatgtgtctcacatactttctggatctttcatattcagcatggtgtgtatgcatagctccttatgcgtatcttatattgtacaaaattgtgcgagtttaatattcccactgtttttaaagaaactttaccctatttacacccattggtctggtgtcaccttcctgtccaaagcaagggacagattatggggactcacagaggccttactacccttcccccaacctggaagtcccccaactgctccgagcccttgctttcccttaagacttcaaattttagcaaacacagaaagtgaaatcttgatcccccacaataaaagggaaatgaggatggggtaagagactctctcttccccttacacctcattgtccttggtttttttatccggtttaggaaaaagcctggattatgaggaggagaggaggaatttccctgaagctctctattcccccacccctcatcccctttcaataggaactgggcataggaccagctgtgttggcagggcttccagcagctgtgttagggcgaaggcactgacaagtgaggttataggggaggggtgctgccaggatttctctgtcataccgtgggaagacaaacccagcttagatgtctgggatccccatccagagtggctggaagctggggaagcagaaaggagactctagttctaactctaaacaacctaatcttccccacttcccatcctcaactagacttctaatctccaagaaatccaatccaatgttctgcccccctggctggtctctttgtgtccctgctgtgtccctgtccatcttaccattgtccatccttttgtcccatgttgcccaggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgaggtaggggctccagcacagggaaccagaggcagtcccaggcatttgggaagggtgttgggctctgggtggctgagaatagggtttgctacaggacctagggtcctaagaaggccaggggaaaggtgtccggtgatgttttagggagccctagcagtacctaggtcagaggggaggtctgacttgctccccaaaactcatccctaagaacatgctcctgccagctggactaagacaacgtgaccagac

SEQ ID NO: 14417 - DNA, 36223 bp, Human
caccaggacctcagactatctttagggaaccccggctggttcattcccactgtaacccctgaggctcttggcctcctcccgtcctcctcttcctcctcctttttttccctccttcccctcctcctcagtttgggcttcccctgtccaagaagcctcaggatgagctttgggaacgaggttttacctgtgtttccaactctgctctgagcccctgagctctgtagtggaggggaggaaagggagaagggagggaaagtggaagcatcgaacagtcaggacactgggctctcatcgcagctctgccgccagccagcagtcaccctggacacatccttgtgcctgagcgctaatttcctcccctgtgaaatgggaacagcaggccctgcctacatcgtggggtggtttaaggaatcaatgagatgacagctgtgaatgttcttggcgcagtacaacatatgccatgtgtttctccagtgttttcaaaggccggtagtgcccgccaccacccagttcagaactcaccacaaaacatgaatttctcatcacttctcaccacgagtcttgtctttccaaaggaagggagaagggaaagccagctgagcacctcttacctgtctgtgctggatggggccttgccacaaggctgtgcagttggaaatagcctcacttcatagatgaggaaaccgaggctcaaagaggtcaaatagcctgccagaactgtgcagctggaagccacaggccaaggctttgcctctctttcctctgctccccatcactctgcaggggttatggtgggggaacaagagaggcttggagcccctcattcagatgcaccaaaggcacccgctaagaagctaagtgtcttacacatcagtggaaaccagagggtaaacaggattccatccatgcccagggctttccgggaacacacctgtccaagcagcagcagttcccaacagagctctggtcccggaaagccggacagccagggctgggccctctgggatttgtttagtgatctgaccgtgtgggaggcctagagtaggagtgggggtggggggagcgtgccgcccagccttattgcatcactcaccgcccaggccctgccctcacccgctcctgaccaggccctgtgcaggttctcagccaccctgccccggggggtccttcagactctactcactgaccaagtgagggactgacccgaggttagagtgctgtgttgtatgtgacctgagaatatgtgtgcacagactgagccccggtgtccttgtgcagttgagcgtgtacatgtcctgcccgtgtgtaggcaacctgtccctacatgctaggagtgtgactccacgtcctgctagagggggaggagagaaggagttgtgcccagggtcccctgatcacttctatgggctcatgtttgtgcatcttgttaggggtgcttgggggtagggaagcctgtgccctgggtgcccttgatcacctgtgtgtgtgctccatcaggtgtgcgcgcctgtgcattgggggtgtactgtgtcacagcttcctaaaacaaccatgtgcgcatgcagacgtttgcgtgtgtgacctacggtgtgagcgagcggatgcttccaccacgtgtctctgcacacgcatgtgtgcacttgcacacctgcgtgtgtcccgagagagcgagcggagcccagcgtgggctggcacgcgcgggaacgtgtgggtgcgcgtcctgcgggtccctgccgggttgactcccagcttgtgccgcgggcgtgcatgagcggaaggcgcccggcggccctgcctggccgcgagtgtgcgcgcgcggggtcccgggccggcgtgcacgccggtgtgagtgcgagtgcgagtgagtgtggcgccgcgcggctccctccgctccgcgccgcccgcgcagcccgcacactcaccctgctttggttgctgccgggtgacgcgggctgggcccgccccctgcctgccggcctctggcactcgctcgcgccgtccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcagtaagtttcccacgcgccgacttcgcgccccctcccctggctcgggctcggcccccccacggcctcgcggcttccctccgccggtccccctcgcgcgctcgcgctctgcctcggttcacaaccccgccgcgggcttgcgggcccctggcgcactcggtgcgctctccgcgccctgcccaccggcctcgagccctcccccgacccaggccggacaggagggaagttcgggggcaccccctgggggtgtcccatttccggggccgggttcctcggagccggcgccgcgccccctccctgccagcccgccctcccggagctccggcgcgggcggctgcttttgttcccgggaagggcggagctgcgtcccggggagacaccagttgctgccggccgcgcggtcgctccccgctcgccagccgctccgggagggcctcgcggccgagggtcggggctggggcgagctggggaggggcccgaggctgggagcggcccggcctcccgcgtggtcccggcggcccgcagagcgcagctgctttgctggcgcgcgagcagaggaccaggaggaccgcggggccgcttgtcctttggaaaaaccttggcgtttcctcctccggtgtccatggaccccgccgcagccctcgccagggccgcgcaccttcgcccacctgttacgcccgcggcccccgggcagagagggccccccagcccgctccccctcctcccggactgagccctgagtccccgggagcaggcaagcgccggagtcccgggaccgaggcccggccggtgggcgctcctggcgccttttcccgtccccgagggtgcctgtccggcccgagccgggactggctgggaaaccgaggccggaagaggtcgcagtccagtgaggagtcggtttgcgcggggtggggatggcatgtgagaaccccctcctagctcagctgtggctccagacttgtcactgagacctggaaaaccagcgtctcgtcaaaccccagcccttcccgggatgtggcccttctccagggctggtgctgcccctcccctgcgcagcagggatgtctgcgcctggcctgggcactcaccagggcctgtgggctgcgggcctggagtttcccaagcatcaaatgtgccaccagaagctgaaggtagggattaccagtgcccccggggcacagaccccccatcgccccacctggggaggcccatcagcagtggccggttagagcagggcccctgtaggggaaactgcctgctttgcactttctagaggcctggaccacggccctcgggccagcgcctggcacatgaaggccctgccctgggcgtgggggctggggagcagtcttgtccctccactttcctgccagcttggggagattgggtcggaagagttttttgccctcagggctgtgccctagatccacccccctcccctctgcccctggcaccctgtgcgaagctcaccctggacttggtgatcccctgggtgggccctgagtgggacccaagtaactgctttggctgccctgaatccaaagcctcccccagaagaacggatgggaaagttgttcccatttctggcatctctgctgctgcaccaaggaagtaagaggggagggcagagcttcaggccaccctcctggtgccacagagggccctctgcatggcgaatggccaagaggctttttctttttctttttttttttttttttgctgtctctgaacccacaaagcaaggaggggaccaggaagctagaaactcaggccagccagccccatctccaatccgtcagctcagcagcccttcagggagcatgtcctggcagcagggctgggcccctggcctgagatacatgcggtgcaggggccagactcacatgaggtcagcagtgcagggcagagctggatgcagctttgccagcttgaactgtgggctggccacacccgtattatcaggacatgccaaagaaatgctgaagacgggctcagaggagctaaggaggacggtgtgccactgagctagggccagcttgggcccctgtcgcccccttcgaggggggccccaccctaggcttggatcctatgggaggctgacaaacatcctaggcccagaagcccagaaatcttggctcttgtccatggtgggggaacaggttctggggtgggactgccttccacccagtaccccaggcggtgcccccctctgggctgtgacaaccagatccttagaataagcctcaatgattcaagccagatggttcattacggctttagccagggttatgctatttgctgccctaattattggattatctctgttctgacaaaaagaaatgagggcggttgctctgttgtccaaggcagagagtgaagtgctgtttatttactcagccttttctcctggctttttaaagccctttctttattaagtcatgtcaaagcacaagcacataactcgcatgttcccagcagatctcgaagaggggcgatgacagggaggaaaggcagtgaatgtcccaatgaggagcaggacccagtgtcggccctgccagttctcctagggtggcctctgtggcgtgctgccctccaggtgggccgtgggccacacaccccacacgctgcccctacctgagaggctctcctgcccggcacccacctgtggaagcccagtccattcttcaaagctgtaatcactagagtgccatgggttgcaagtgacagataaccaactcagagtggcttaaacaatgaggacagctgaggtcttgctgcaccagggtgcaccaatgcagcagcccctcagcactgttggggtgatggttctgtccatctttgctcgtggctgtgcgtttttccttgtagagcaaaatcaaggcccgtttcctattcctaagggtgtctgggtgaggaaggttcaggtgcagaccaaagtcagaatgacgctgtcagtctccatcagccaagcaggaccctcaggtccaaggtggctgctgcaggtccaggcatcacatgtaacaataaggtccttgactgggtaaggaattggtaaggaccgattccttttctcatgtctcagtttaagagcgaggaaacctctcccagaagtccccaggagacctgtccttttgtctcattggccagaattggatcacatgcccgtgttaaacctgccctgtgtggttcacccaggaccgggtcaggaccgatgcctgtgcaggtctggagcaaggacaaggggttgagtccaccacaaaggttctccgtgttagggggcatattccagcccccatgggctgtggtgccccttcctttgagcccagaacctctttggccccagtcatgttctacctggacctgtgatatttgtaatgcactcgatgttacggcaccaactatgtggcaggctctgtgttaggcacagagatacaagaatgctgagaggcaacctctgacctgagggtgttcatcaaaaccaagacaaacaggtgaccccacagcgagggacagggaggcaagaacccagatggaaagctctggcaggcggaggtcactcacagagagggctcagccctaagactgggaggagggaggaggtgggctgacagagggaaaagaggaaagggaggtgctcttcgcagagggacagctgtgtacacaggtcctgaagtgtcagaaactcagcccagtgtaggcaaaacagtagagccaagtggctcaaagaaggggaagagacctatgaggaggccaaagcggtcatatcacacaaggtcttgaatgccacaccaaggaggttgaactgagtccaggagttgatggagaacctttcaacaatttaaagcagatgaatgaagatgtttataaaaatcttaacactcgtctctaagctcctgggaagcagggatgatggctcatttctctctgtcccccctgcagtgccggcctggctgaatggctgtttccccaactataaaatgctttcaacacaagcttgatgattttctatggtccttgccacaattgttttgttttttttttaaagtatttgagagcctgacatttttcttaaaaaaaaaaaaaaaaaaaatcagggcagatttcctattcccaagggtgtcaggaaagtccaggtgcaaaccaaggttatgatgatgctgtcaggtctacatcagccaagcagggggtgctcggccttagaggagccaacaggggcttgagcttgattttctctgaattagccccattaaagctctgtaattatcgacaagcgggtgacaactctcaaaggcccattagtgaccaaccctcattatttttccgaagatgtaaacttcagtggggtcatgtgattggagcgctccaagggcagggcactgtgggtcacagagaagcaccttctcctgcccttagggccctcctcacgcccagcacaagcccaaggtgcttttccaactcggagggctctccagggcagcggctgagcccccactctccttcccctagagcaactctgcttttctctctttttgtttcttagttgcatcctcctaagatttcagctaaacaaagtggccaaaaaaaagctttttggaccagggcagagtggcccgtgtgtgcctgtaatcccagcactttgggaggtgaaggcgggaggattgcttgagcccgggagttcaagaccagcctgagcaacgtagtgagacctacccccccgcaccccccgcaccaacaccactgtctctttttttgtaaatatattttttaagttagccgggcatggtggtgggcgcctgtagtcccagctacttgggaggctgaggtgagaggatcgtttgagcctgggaggctgaactgtgatcgcaccactgtactccagcctgggtaacagaacaagaccctgtctcaaaaaaaaaaaacttcttgggagccagtaggctttaagggagaaactatcaggatggaagtgaagaggcctagattctgtgcctgggtctgctgggccacgctgagcagctcccctcccctctctgagcctcatttctctaaagggaaatgaagagtttgggccatgtgctccgtaagagagcttcaccagcctctcaaaactgtgaccgagcttctatttataaactatcatttcttacagaccttccagtggagttcaaagaaattcatcagtcccttcctggtgacacactgggtgtgctgttccttcccaggaggtggtgacgggtgtcagttttccccccaggcagttggagaagatcgctgccctccttggacaggggtttctgtagagccagtgcaggggcttctcccctccaggagctgggtgtcccagggggagcaggcagccgctctgtcttctggctgtccttctctggggttgggaaacaggcagaaatcagaatgtgcatttttacacttgggtgtcacaccagatcccagctcctgggagcacctggagggcaagttggtttgaatggaccagccatgtgtgtctgcatctgctgtttgttggtctcacaggtgtggccaaggcatggtccctgtgctcagggggctaattcgttgggggaacaaaccccaggtaggcctgacctgaacagcagatccatttactatcatgtaaagccaacagcttcagagaatattgttacaaaagtacagattggtgcatctcgggctgtggctgtgttcattgctgcaggagcagtgggatacacctcccttccagcagcctcacctgcctggtgtggagatggcagctagcatgcaggcagctgaaggccagctacagctattgctgctgcacacataccctgctcaggagaacgtgcctcaggcttcactcaagacctagtatttatttatttttttgagacaggatctcgctctgtcgcctaggttggatgcagtggcacaatcacactcactgtagcctcaacttcctgggctcaagcggtcctcccacctcagcctcccgagtagctgggaccacaggcatgcgccaccatgcccggctatttttgtattttttgtagaaatgggtgtttccatgttggccaggccggtcttgaaatcctgggctcaagtgatccacccgtctcagcctcccaaagtgctgggattataggcgtgagccaccacacccggccatttttgtagtttttgttgccatgttggccaggctggtctcgaactcctgagctcaagtgatccatctgcttcggcctcccaaactgctgggatgacaggcatgagccccacaccagccactcaaggcctgttggctcttagtttgcacacacttccaacaagtatcatcacctggtctcatgggagaaacaattattgaataggtgagagctgtctgcgccaacacagacaagtaatctaataggagtttcaggctgatgtcaaaggaagaggcagaaaaatgaagaaaaccgaaaagagggccacccgggaccctctggtgcaggggttgcttcgtgtccccttttgcctctggaacatgaccgtgacatacggaagagtcatcgtggccatagcaatgactcaggttattcaaaaaatttaagtgactatttgtatgttctgttcccaaaggcagggagggaaatgagccaattgaggacagtttcattccagaatgggtcttagagaagccagtactgttagctagaaaacccaccatagggatctgctccttctataatgatctactgagcacctcctacaccgcaggcacactgtgctgtgaggtggatactatcgttgtctccatttcacagatgagtaaactgaggcataaagacgttagataagctggccacacagcagggaagtgcacgctgggatttgaaccgaggagactgatgtcagagggcaggtcttgcaccccacactgctgcgaagacagagacatgtgcctgacccgtgttagaaggggatgatctagacaaatgccactcccatcaccagctcagaataaaggacactccacactcgtggcctttcattagccaatttccctgcagacccaagaaactttgttatgcctgggcccagcactcgcccagagatctgcaaacttgttctataaagaagggctggatagtaaatattttcagctgtgcaggccgtagggtctgcttctgaagtaggaaagcagccgcagaagagatgtaaatgatgggcctggtcaggtgtggccgtaattggatctagatccaggttgggagcctagctcagagcctgaagaacacagtctttcaagtttggccttcccttatcccgggatcacaccagccactaagcccgtacctgctggttggcctgtggttggaatcgtcacctcccccagcccctctttgccattggccaactcctactcatccctcatggctcaggtgaagcatcacctcctccaggaagccttccctggtggtcccaattcacatgggctccccatggctcccggctcaccagactctactgcggcaaattatttccatttgttcctccccttaagctgtgctttccttgggatagggactctgcctcacagatgtccatcccctagagtctggcatgttgtaaacacttggtaaataatgaaggaatgtgacaccatttgaccagccctgcagcctgggagcaggctctgggcttctgaagccatctgtgaatgtgcatcttgctgtctgcggactgccactaagctctgccccccaccatcatctccaagctctgccccaaccatcaccttggcctccatgctgggagccgcttctgcatggaaagccacagctgctatgagtgattgcccccggggagggaggcagctgcacccaattatggctgcaacctcccccaattatggctgcaccctccccccggcttttgggagttaccactgccattgagagacttgggggcagcagtatgaggacccagctggctcctcacggcctgctcggggttcccaacgggccagagagacagaggagctgcagtcctgtgtgttggctgggggactgttgagcaaatcagctgatcttcctggccaggacctgttcctctcaaagcctcgtctcctccgccttgtgtgatccttgtgacatttcacaggtgagggaaactgaggcacggggcccagactggcagttgcaccaggagggcaggaactcctttggctgggtgcccagctcaggtggaccacacactgggccagacagggaactggagtgacccacctgacctctctgggtctcagctcctcctctggaaagtggggagattattgtgacttcccagggttgggtgggactgggaggatgggtgaggggctggcatagagcaggtgcttggttggtggcagccgccatggaacggtggcacctgcccaggccaggctcatctggtctcacaggggcaggcgaagcctctccaagatgcggccagggtgggacctgtgccctcctctgtccgcagctgccctgggcacgctggacttcagcctgctgtatgaccaggagaacaacgccctccactgcaccatcaccaaggccaaggtaggccccgccagcctgcccccaaattccctgccccggggtcctcaagagggcctaggtcagggaggccagaccacaccactccccaggttcctgtccaggcttttggatgtctgtgctgtgtggggtgcggggccaggaaggaattcttctttaaaccttcttgaatacccaaccccaagaaatgccttggacagtcaggcattgcggggagcaaagaaacagatgagaatgggaagatgaaggcctggaccgaggaccctcgagcctggggaggggctgctgagagggaaagagaggggcagggtgatgtctgtcctgcaggccaagggagggcgggttgggtactggtgcctccaggcctcccagacgccctgaggagtggggacgccactttgcaccctggaagccgagccactgtaggaggccgatgccactccaggcagggtgtccacggcctgagcccagaggccctctgagcctcactacgtgggctggggttgtgggtgcctgtggacccctctgcagcctggcccggccgctggtgctcccctctgcagcctggcccggcccctggtgctcccctctgcagcctggcccggcccctggtgctcccctctgcagcctggcccggcccctggtgctcccctctgcagcctggcccggcccctggtgctcccctctgcagcctggcccggcccctggtgctgccctctgcagcctggcccggcccctggtgctcccctctgcagcctggcctggtccctggtgctgccctctggctctgccactcaagcatgtgtcagctccatgttctcaactgtcctgttcccttcccctcaccccattgctccctgtgggaggaaggtgccaaaattgatgttctctcgcaaggtaagggcctgcatggccagtagagtctccctagtagtgccatgtaagggcctgagccagcccagctcagatccagcggcttcccacagagctgcctgggcccaggccccacccagcctcccaacctgcaggccccctgcccctcctcccagcctggcagcaagggctgcccttggcagcatgctcacccagcaggacaggctactgcgtgccaccccaggctgtcccccagcccagcctgggccacatgtggactgccgtgggtaggtgtgagtgccatccacgcaagcctcagggccctggtagggcactgagaggcctgcacgctccatcccacccctgccctctctagaaccacccatgctatgactcagggcatgtccagccctgcctggcgggggctccagcccacccctaggagcagaactgagcatttgtcaaaccccagctgtgccaaggtagagaccaagctagacccttcctcctttccctctgtccaactttgtagaggtggtccaggcctggggactggagaggtgccggctgccaggccactctggccaaagcccaccccttcctctctccatgccagacaccagggccttcccttcccagctccaggtgcgtttgtgtgtatgcacatacatggctgtatgtgtgtctctgtgtgtacatgtgtggtaccgtgcgtgcacacatgtaagtgtgtgtccactttgggctgtatccctcaagtatcagaagtgggggtgggaggcccagttccttctctgtgtaaatccagttctgtagggaaggggtggtgcaggctggggaagagctggggctctgggctggggtgtggggaggggcccagggtgggtgagctgaagcagggctggcctctggagggccagggtgggggctggacaccctggggtgcacccttgcttgtccccccttataagggtcagtctcagtttgcccatctgtaaatagggttggttgtccctgccctacatgcctgttgtgagcattaaatgagttaacacgcggcccctggcactaccagttctgggagactttttatttttattgtggtaaaatacacagatatacatttcccacctcaaccacttttttttacttcttccctcagcgctcaaccatttttagcgtacagttcagttgtgctaagtaccttctaccttcacactgctgtgaaacccatctccagagccctcttcagcttgcaaaactaaactggacccattaaacaacagctcccccttcctcctcccctggcccctggggaggctgccatttggcttccttctctatggatttgactattctagggacctcatgtaagtgcagtctcccggtatctgtccttttgagtctgcagtccccgggatctgtccttttgagtctgccttctttcactccgcagaatgtcttcaggcttcatccccattgcagcacgtgtcaaaacttccttttcaggctgaatgatacttcagactagaaagctcctcttctgaacacttcaccagcaacagcctctgagaggcccagggcggggcagggctaggtttttggggagaggctctcctctcaaagccagaccccccatctcttccctcagtgccagtaccagccagggcctcccccggggccgcttccacccatcctccctgtattagtccattttcatgctgccgataaagacatacctgagactgtgtaatttataaaggaaagaggtttattggacttgccgttacacgtggctgagaagacctcacagttatggctgaaagtgaaaggcacttctcacatgtttggtggcaagagagagaatgagagccaaggaaaacgggtttccccttatcaggccatcagatctcgtgagatgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacgtcaagaagagtgtcagaccatgagatctcgtgagacgtattcactacctcaagaacagtgtcagatcatcagatctcgtgagacgtattcactacgtcaagaacagtctgggagaaacctccccttgtgattcagttatctcccgctgggtccttcccacaacctgtaggaattatgggagtacaactccagatgagacttgggtggggacaccgccaaaccacgtcacctcccgtgaggcccacccctaaaccatgggatcagtttatgtctcttgccaactcccaagctggggagcatgtgcccaagggccccactagcagctccctgccctggaaacagcctcccgaccttccccttccgtggacagaggtcaggctccgtgggaggccagccccacagaaggtggaggcactggcggaaccccgggtcaggaccagggaagctgcctgtttgggcacagaagttggtggcagcacagtgacagggcttcaggcagtgcctgctggtccttttgcttttggcgaaatgtgtggctgcccagggtgctcagggaactgccgggtggaggagtagagagcagcagcaggggcctcgtcacagtcccggggtctgaaggacagagcaggcatcactcccgtcccagcatgacagcgcccctcgacccagcctagctcccacgggtgtctcggggtacggaggtgggaccaccagagccactggaaagacatacgccagaacatgtggtggcccaaaggtttgtaagtgaaacgtgtcaggaaacgtggcccaaatggaaacattttaagctacaacaaacaaatgtataaggactgtaagaataagacacagcagtcaggcacctcctggtcaggccaggccaccagattcccagaactctgcacttcaggcacttggtgggaaaggtgcaaggcagggtgagggagttgggtttggaagagcagccttgtcaccttgagcacgtgttgggccactgagccaggccctgtcccagaggcagccccacagtgcagagcacagctcagatgcacccagcagacctcaaccgcttctccggcgtctcacgggggcctggcgtgcagggaagggagcaaaccctgcctgccaggccctgtgtccacacagtctccctccctctcactccagccctaggaaggtgggagtattacacccccgccctttttttttttttttttttaaacttgagacagggtctcactctgtcacccaggctggagtgcagtggtgcgatcatggttcactgcagcctccgtgtcccaggttcaagcgatcctcccacctcagcttctctagttgctggaaccacaggcacatgccaccccacccagctaattttttagttttttgaagagacagggtcttactgtgttgcccaggctggtcttgaactcctgggctcaagcgctgggattacaggcgtgagccaccgtgcccggccaacccctttaacagatgataaagctgaggcttagcgtgcaaagtaactcatccacttcccagctggtgaacaggagctgagcctggagcccaagccagccaggcccccaaacctctgccctttgccagtggcagggaagtaggtggttggaagcccctgccgcatcccccagagctccgtcaaaccgaggtggggtgggcctgggagggagccccagcctccccttggagatgggcctggtgtgagccgccgagctgcctccctgacccggctgggtagaagccctttgaatactatcctggggttgccggctgcacccccacagatgccacagctgcctccctgcatccctgtgcaccatcccagaaggaaacaaatgcaattttcagagacaagagcctgctgaggtcagcaaagcccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctcagactgtgtcccggggttatgtggatttagggtcagtgaggggcatggccactcaggaggccacgcttggtagatgggagacgggagtcaggatgacggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggcttctgtgaaaggggccatgaatgggcccagccaggagacccaggggacaagggcatctgcaggccctgtcagttccatgtccccgatttccagttcacaccgtttgctgttctctgcccagggcctgaagccaatggaccacaatgggctggcagacccctacgtcaagctgcacctgctgccaggagccagtaaggtgaggggttccacctaggcctgcccaccagctgcacccgcccaccacctcaggcaatgcactctggtccttttgctttggggcctggactgggctgcgggcacccagggaggcccacagctgccactcccctcagagtccaagcaagctgatgggacctcagccattcaactgcacacagagcacccagtctgccccacaccctgttgcctcctggggacctcacgagtcagcgttacctacctgctgatctggggaaacccctggagaatttccaggccagcattttataagaagcattctcagctggaagttactattaggtgcaaacaaaggactctgtggttaaataacatggggaaacattgttaaacgggtttctgtaccacaggacttctcagagcatctaacgtgttgatgggctgttccctgactctccgcaagggggatgaagtgggcagaatctgcccctcattcctacgccggatgacccaagcgtccgaccacacatgtgctcagggcaccagcacaacaggtgcatctcggacaggagagagaaaaattgctgttaaataaaagcatcaaggtgaccttgagccatggaaagtcagaacttaattagacttccttctgtgcatcctacacttcagtgctgttttatttttaatttcatggggcagagtctgagtttacgtggaggcctaaatgggtaggcctggggcccacagcagcccaggaggaccaccccagaaggggcccttcccccttctctagggaaggcaggactgtaggagaaatggcagtgccccaccacctactcctggggaagaaatgggctccccacaccgggtcttgatgcccttatgctgcaagaagggctcagggatatgagggccgagggcgagtatgaccagggaagtgtgctcagtgacccttcatttgtgggactggagccggcagtgcatggctgccgagttgtaggaagtccccaggactttccctagtgttttataaagagcagtctccttacaaacagctcctgaaagcaatgggagagagggattcctgtgccctttccacagtggggaacctgatgctgccacagagctggaattggaagcccaggctgtctgacctcccagcctgggccgggtgtggcaggcatcagaccgattcagacaaggagctcagagccgctggcacaggaggagggagtggcagcaatattccagctcggagaggccacccccgaggcagacccaaggacgggatgggttccaggcagaggggacggtccacaaaggcagggaatgccctgggaaggagactccagttccacacaggcctcctgcagaacctaccccgtggcatcgggctggaggtggggtcctccttggatgagcctcctacggctgctgcaacaaatgaccacaaacttcgtggcttaaagcagcgcgtttactctcggactgctctgcaggttagaagtccagcagtggtctctctctgggctaaaatcaaggtgtcggcaaggctgcattccttctggagcccggggagcccacagtttcctagcgccttccagcttctagaggccatcggccctcctgggcttgtggccccttcctccaccttcacagcgggccccattgcatctctctggcccccttccttggtgacgtccctgactgtcttctctgtccattcttctgcttttaagaaccctgtgaccacattgggccacccaacaatctaggataatctccctattctaatgtcagctcattaccaaccctaagtccacctgcagcctcagtccacttggccatgttgataacacattcacaggctccaagatgagcacgtggccatctctgggggccattgttctgtttgatacacactttgatgctaataagatcatttttctcttctccaggcaaataagctcagaacaaaaactctccgtaacactctgaaccccacatggaacgagaccctcacttactacgggatcacagatgaagacatgatccgcaagaccctgcggtgggtgagggtcccaggccgcctgctccctccccaacccccactcccacccggcttttcctaatgaaggcaggactggagggtcagatggtcccctgtgggttcaacctcatgccagcaactccagcctgggggcttgaagaaaggcagaaaggtctgcccacgccaatggagcctggtgggtggaaaagggtcaccctggccccagtcccctgaaggtgcttcctggggcctctcagggtgctggaggtggttccctccagagaaccggctctcccagcctcctggctactcctggcactggttctgccttctcctgtcccctcttccaacctgaggacacttgtccatgaggacagtgcctgatatcgtgccacactctgcccctgtcagggcccaggcatcttgtgcgtctcccaccccagaccagggcagggcttggggcaggagaagccagggctggccctacctgcgcacacctccaccatgcccagtgcgtctgaggcactggctgtgcccctcaccaccgccccctctaggatctctgtgtgtgacgaggacaaattccggcacaatgagttcatcggggagacacgtgtgcccctgaagaagctgaaacccaaccacaccaagaccttcagcatctgcctggagaagcagctgccggtgagaggattgattgagcacctgctgtgtacctggctcggtggcaggtgctgggaaggcagaacttcctgcctgtgatgggactcatgaggggcagagtgagaggggaggggagaccggggaggtgagcatggagagtcaagggggtggaggtgaggaaggaccctggctttcactctgagtggccacgggagggtgctaagctgagggatcatgggggatgacattttaccaggctcgctggcctgggctcaggatggcttgaagaagagggaggagagggcaggaggcctggggagatggggagagatgggcacaaccctggcctgaccttggcagcggtaggagggcttgattctgaaccagatgtgcaggcagcagataggacgtccttgggtgagggaagggcagatccgaggtttggggcctgagccactgaagcctgaggggctgtttgctgcactcagaggactcagcagggaccacgggtggacaggacgcgcaaggagcacgcttggaacatgttagacctgagtgcctgtgagatacgcagaggagacagcagagtatcctttcctagaaatggcatttgtctcaacgttatgtcagaacagatttgcccccggcctgctccagcagctacgccctctgagtcttggtctctatgtccctcttccctcccccatcctcccttgtctatggcctcaccttcacctggttcatagggctggtgaagccaggagtcccccgtgccactggggtcaagagaaatcctggggcctcagcctcccagcgttcaggacacaggcggaggcatggtcccctcgatggcacgttgtccccctaagaggactgggcaaggggcaagtttgggaggacagagcccggcggctgtccccagtgtacccagccccagtggggcccggggacgtggactcacctcgagcttagcccaagtcaagccccgggggcgagtcagcctgaggccacggcttcttcccagaatcccagttacttttgcagaatttgatccaattttattccttgtcacattctctccccctcagacatttgtgtgatggatataacctttcctgttttattgttagtcactaaccacaggtaacccggtttttccacatggtctatgtcacttaagaaaggcaacatcttaggaggccaaggcaggtgggtcatgaggtcaagagttcgagagagcctggccaacatggcgaaaccccgtctctgctaaaaataaaaaaattagccgggtgtgggggtgcatgcctgtaatcccagctactcaggaggctgaggcaggagaatcgcttgaacctgagaggcggaggttgcagtgagccgagattgcaccgttgcactccagcctgggtgacaagagcaagagcaagactctgtctcaaaaaaaaaaaaaaaaagcaacaccagccctgccttagtgttcctgagttttcatcactggcataaacaaacaaccacgtgggtatgtacgtggggtgtcagcgtgtgtgtgtgtgtgctcgtgtgtgaattgtgtgtaagagcatatgtcagtacgtgtctgtgtgcgacagtgtgtgtgtccacatgtgtggtgtgcgttcgtgaaagcatgtgcgtccctgtgcgtggccatgatcagggcgttgctggatgcgctaccggcccattggtgccgttcagggactcacagtgaccgcaggagtgcagctggggatgcacccctgacagtacagccacattctggtggtacttttattattattattttttgagactgagtcttgctctgtcatccaggctggagttcagtggcaaaatctctgttcactgcaacctctacctcctgagttcaaacaattctcatgcctcagcctcccgagtagctgggactacaggcgtgtgccgccacgcctggttaatttttgtatatttggtagagatggggtttcaccatattgtccaggtgtctcaaactcctgaccttgaatgatccacctgcctcagcctcccaaagtgctgggattacaggtgtgcgccaccacgcctggctaattttggtatttttagtagagacgggggttcgccatgttggccaggcaagtctcaaactcctgacctccagtgatcctcctgcctcggcctcccaaagtgctgggattacaggcatgagcccctgtgccaggcctctggcggtaggttttagaatttacagtctgcgaacattatctgttttaagtcaatactgagcaagacccagtggtcttcatatgaaacaacccgaagtacaatgtcccacccctgaaaaaagagctaaaaatatgcctgctggttggttgttttttttttttttttttatgagatggagtctatgtcgcccaggctggagtgcagtggcgcaatgtcggcttacttcaacctccgcctcccgggttcaagtgattcttctgcctcagcctcccaatagctgggattacaggcatgcgccaccacacccggctaatttttgtatttttagtagagatggggtttcaccatgttggccaggctggtcctgagctgctgacctcaggtgatctgcccgccttggcctcccaaagtgctggggttacaggcatgagtcactgtgcctggcccctgctagtttatattgtttaattttcacaccacacacactgacacaagcagcacagggcatcaaggccctcacacacaaagctctgcctgagcggcagatagcgagatctcgcaggcctggcctgatccaccaggaatggctgcctgagcactgtgttgaaaaggattctgaggtggcattggagcctagggcaaatgctaggatcgattagccatgtctgctctgggcgtgggaggtggcgaaggtggctggtggggcatgtatgtcttccctgctcaacatccctgctcacctcacaggagtctcatctccagaaagggttagatgtagccagagggactcactttggtgttaggcaaggcacggttgtgggcaaaaggaggtggctggggctgcttgggagaggagcctggtagagtcctaaggggatccagggggacacagggctcaagctgggcgtgtgtgggtgggctcaagctgggtttgtctgggggggctgagggcctaggagagagggtttggggtgtgcagcagccagaaggaagaagccgggtagtctcgggagggcaaggaatggagaagcatcaggctggctggggatggggaggcctggagctgagatctgccttgagaggcaggcactggcagctgctgaggcagggaaggcactggatgggctccctacttggctcccagcttctccagggtgaggaatgtaccagaactctgtcttcggggttctcctgagggagccacatccagcaccctgagaggctccaggtagcaccttcagggaactggggccacggtgacccttttccatccaccaggctccattgtcatgggcagacctttctgcctttctttgaacctccaggctggagttgcttgtatgaggttgaacgcacaggggaccatctgtccctccattcctgccttcactagtacaagcctccagtgggcccttagtgccagggccttgcccagccctgaggtattaaagatgacgcaggtattatctggatgcggtggctcatacctgtaatcccagcacttcaggaggctgaggtgggtggatcacttgaggtcaggaattcgagaccagcctggcagacatggcaaaaccctgtctctaccaaaaaatagaaaaattagactgtagtcccagctactcagaaggctgaggcaggagaatcgcttaaacccgggaggcagaggttgtagtgagccaagatcatgccactgcactccagcctgggtgacaagagtcagactctgtcaaaatcaaaatttacaggtagagttccaaattcaaggaacttagaggctggggcagacccctgaggaagcagggggccacaccaggccatgacaggataaacccgaggcagtgggcgcgcagaggggacggccaacccaccctgagggtcagaaaagccccccaggcccagaaggaccaggaatttatcaacggtgaacactgaggaggtcagaggagggtgctggagctgtggattaagggtgcgcaaaggtgtggaggtgggacccggcttcaaagccaagggaaagtccgggcgggctgtgaggaggacctggtggaagaccgtccgcggaagccgagcgcgccaggccgggggctgcagacccgtgaagggccgcttagtgctaatgttaggctctgtgtgcctcgcaatctgtggccaccatgcagctctgtccttagggcaaaagcagccatagagaagcatcacggagctggcaaggctgcgttccaacaacacggtgttaatggaagctgaagtgtgaatttcatgtcattttcatgtgtcacaaaatatttttcatttcatttttctttctgctattccaaaaagtaagaaccagctgggcacggtggctcatgtctgtaatcccagcactttgggaggccaaggtgggaagatcccttgagcccaggagtttgagatcagcctgggcaaaatagtgagacccctgtctctatttttttgaaaaagaaattgtttaagataagggtaagagccatgcttagctcacatcccacacagagccaggcgtcgggcctgatctggcccccgggctgcagttgccaacccctgggctggcccttgctgggctgtgaaggccaccgtaggccacatgcagccaagaacagggagggtgtgggtcagatccagccctggaagagcccttgggagggaagagatgacagaagggctgtgagttcacagtgaggccactcaccagggaccgtgaccaggcccggctgcagcagccggatgggcgggctcaggaagaggaggccaaggacggccaagagaggggtgggagcaggtgaggactgagtgaccgtcccgtccaacaggtggacaagaccgaagacaagtccctggaggagcggggccgcatcctcatctcgctcaagtacagctcacagaagcaaggcctgctggtaggcatcgtgcggtgcgcccacctggccgccatggacgccaacggctactcggacccctacgtgaaaacgtgagtgtgccgtgcgcgtgaccacctgccacgtcttcacctccaaggacgggggtccgtgtgccggctccgtggtcccaggtggcaggcacccagggagtgcctgaggtacaggggcgctgtgttccctgatgggctaccttggcaactccaggggttaagcatggccagcccatttcacagatggggaaactgagggacagagaagctgagtggcttcccagggtcatgcaggtattagttatcacctgatgctatgtccaggcctctctgtgactgaggggcccaggaggggccatgagttgcaggaggggacagaaggcagggccagtgccgggggtagccaggaggctgggggaggatgcagaggaactctgccaggcctttgcaactgcccacatttgcccagccctataatggtgctacagatgcggataagagtccacccagctctaccaacagggctgatggtgggcctggggagagacactaactcagggggccatgccaggtggcctgggccgcagagctgtggagctgtgagcctggtcaggagaggctgtgtagctctgagagccaggcaggagctggcgaccctttggagagggtgctacaggtgccacagtgactaccgtcagtgctcggggctcttcagaaactaggtaggtatgagtgtgagctcacagggagactctggaaaactgagacttggggaggaatttagttcagcagaaaggaggggcaggtgcttcagggagggggaatgacagagggatggccctgacctaggggacaccaaggacccaggtgactaaggcctcagggacatcttggcaccatgaagaggccagtactcctcgtggcacagctctaggggcaccattcccatggccatgatcatatttctgtcactttaaaaattgtatgtggcaggtgcagtgagttacacttacattctgaacactttgggaggccaaggcaggaggattgcttgaggctaggagtttgagaccatcctgggcaacatagtgagacctccatctctacaaaaaaattaaaaattagcctggtgtagtggcatgtccctgtagtcctaactacttgagaggattgcttgaacccaggaatttgagaccagccttggcaacatactgagaccttgtctctacagttaaaaatagtaataaattaggctgagtgcagtggctcgtgcttgtaatcccagtactttgggaggccgaggcgcacggatcacctgaggtcaggagtttgagaccagcttggccaatatggggaaacccgtctctactaaaaataaaaaaattagctgggtgtggtggcgggcgcctgtaatcgcagctacttgggaggctgaggcaggaaaatcacttcaacctgggaggtggagattgcagtgagccgagatcacaccactgcactccagccagggtgacagagcgagacactctcaaaatataataaacaaataaaaataatatgagaataatgggatggccactttgggaagcagctgatagttcctcagaaagttaaacacagaatcaccatttgatctggcaattccactccttgttatatacccaagagataagaaaaacatgtccatcctaaaacttgtgcaggaatgttcatagcagcactatccacaacagccaaaagtggaaacaccccaagtgtccatccactgatgaatggatacacaaatgaagtctgtccctgcagtggaatatcagccctaagaaggagtgtagcaggtgcgtggaatatcagtcataagaaggagtgtagcaggtgcgtggaatatcagccctaagaaggagtgtagcaggtgcgtggaatatcagccctaagaaggagtgtagcaggtgcgtggaatatcagccctaagaaggagtgtagcaggtgcgtggaatatcagccctaagaaggagtgtagcaggtgcgtggaatatcagccctaagaaggagtgtagcaggtgcgtggaatatcagccctaagaaggagtgtagcgggtgcgtggaatatcagccctaagaaggagtgtagcgggtgtgtggaatatcagccctaagaaggagtgtagcaggtgcgtggaatatcagccataagaaggagtgtagcaggtgcgcggaatatcagccctaagaaggagtgtagcaggtgcatgctacactgtgggaggaccttggaaacaagatgctaagcgagagaagccagacacagacggccacgtgttgcaggactctatttctatgacgtgtccagaataggtcaacccacagaggcagagagtagatttgtggttgcaggagccaggggaagcttgaggggacatgggcagtgtgtagaatgtggtactatgaagttaaaaatgaataaatttgaactagaggaattattataacacggacagctgtcgaaaacacaacaaacgacacacacagtaggatactggtttgcgtatatatatgtttttttttctgatttgtcattgacttgaatttcacgcgtatatatccttgcaggaggatatgcaatctgaagccaaaatggtgtgatttttttttttttgagacagagtcttactctgttgcccaggctggagtgcagtggcgtgatctcagctcactgcaacgtctgcctcccaggttcaagcagttctcatccctcagcttcccaagtagctgggattacaggcatgcgccaccacgccaggctaatttttgtatttttagtagacggggtttcaccatgttggccaggctggtcttgaactcctgacctcaagtgatccacccaccctggcctcccaaagggctgggattacaggcgtgagccactgtgcccggcctatggtgtgacatttttaaaccagtttcaatgcccacctgccagatggacaggaattccagggtcacctgctgggttgcccagaaagcagagtcttacctgctgtgacagatggtctggtcaacttccacaggcaggcggggggccatctgggcagggcctgtccactgtaccacaagctcctccctgccacaggtggctgctgtgggtgctgctggacccctgcagctgggtcccacctgccagccgtgggccaggtcacgtggcctttcaaagacaggccgagctgtgggccactccctgtatctgagccacgcctcacccgagacctccacatctgtttcagacaccctgggtgagacacgacggctgctgctcggggctcctcaggggtccccgtctctgaaaggccccttcatggaccaggggcctcttcctcactaaagcagaggaaataagggcacagattagatggtaagaggggcacccctcagctgcatcctagacctggaagagagtgtgacctgtgccccagaagaaagggagggacgtatctagcggttgatgctgagggccaaagctagatgggtcaaggccttttgtctgcactattatttttatttgttttctttatttcttcctttctttttcgagacagtgactcactctgtcaccgggctggaatgcagtgatgcgatcacagctcacagcagcctcaaactcctgggctcaagcagtccttccccctcagcctcctgagtagctgggactacaggtgtgcaccaccacgcctggctagttgttttttgtattttttgtagagactgggttttgccgtattggccaggctggtctcaaactgctggactcaaacgatcctcctagctcggcctcccaaagtgctgggattacaggtgcaagccaccatgcccagctagcaccattatttttataaagctcatctctggtgatacttgccccagtttccccaggctggaagttgaccccaggcccagctcttgagggtttgatggaaaaccccaggagtagcagtgcctgtgacaatcgctgacatgtcgagttacacgtaatatccctgagctgcgcgatggctgcgtgtgacgcgctcagcagcctgtgcggtcgctcctgttgttatctccatttcatgcctgtgaaaatggcagtaactggcagcaacgtgctgtgccaccctgggcaactcccttctctggctgtcttatgtataaccagaaggggtttcttctcaaagccacaggcaagcagaaggcactgtgcagagggctcagaggtacacggcacagggcggctccgtgagccccggaggccaggaccactgtcctgacagcaagggagggagagacgccacagggcgggcctcaggggctttgcagggtgggcttgtgccagagtagggtatgctcagggagggtgctgagggatttccccagagtggtcaggtgaggagggaagggcacttctggtagagaaaacagcagaacagagggcaacgctggcggaactgtccatggctgaaggtgccgaggctggagcctgtcgtggaagtctggtggctgagtgaggggtcaccagatgggcacaagttgtccaggctgagggtgcagagatcccaaaacaactttccttccaggggcttgtgaaggcagggcacgcaggacccttctgtccctgctcctcacccgtcaccaaacaggccaaggacagttcacagcagacacaatataccaatacctagagaaatggccaaggagcatagtaagtaactaaggaaatccgctgtctccgggtggcgggcttaggggaatccccccaaacttttttaaaatcaggtttattgaggtacaggttgagcgtcccaaagctgtaaatccaaaaccccaaacattccaagcaccgacatgacgctcaaagggaatgcttattggcgcgtttgggatttcagatttttgaatttttgagttagggatgctgaactggtaaatatactgcaaagattacaaaatatgaaaaaatccaaaattcaaaacatctggtccaagcatttcagataatggatcctcaacctgtatcattcatatccagtgagtttttcttttcttttctttttttagagacagggttttgctctgttgtccaggccaaagtgcagtggcgcaatcatagctcattgcagccttgaactcctgggctcaagcatcttcccacctcagcactgtgaatagctgggactacaggcatgcaccaccatgcccagctaatttttaattttttggtagagatggggtctcgctgtatcacccaggctgggacagtcttgtttccaccaccagaatcaacacagagaatatgaccccagaaagttccctggccccaggcaaccactcacctgttttctgtctcaatggtgttgccgtttccagactttcccatgaaacagtcagatagtgtgttgccctgtgagtccggcttctttcacacggaggaatgcgtttgagattcatctgtcagttgcatgtaccaggagtttggtcctttttgttgctaagtggtcttccattgtgtgggtaaaccacaagtttgttgttgatgagttccccagttgaagggcgtgtggttgtttgcaatttttggtgatggtagaaagctgcaatgaacaggtttttgtgtggacatatgtcttcatttctctctcctaatcccaacttttgtccacatgcattttctagtgcttctgtaataaaccagtattatttatgccatgaaagtcacaattttaaaatatgcaaagtaaagcaactatgagatatcattttctgcctctcaaaccagcaaggagtttttaaatgatagcattcagctttgtcgcaggctactgtgtgtcaaccatgcagcctttctggagaggaactgggcagaataagctggacatgggcgtgtctttgggcggtgccttcacttctagggatgcaggttaagctggacatgggcgtgtctttgggcggtggcttcacttctagggatgcaggtattcgctggacagatgtttgttaagctccctggtgccaggcccagggagttggtcgtgggtgagaccccagagaccccagagcacattcagcagggacaaggcaattgtcatgcaattatctatgcaggaacagggtgagaagctttgcaaagaagttggggacctcttgtccccttctccagcctgcacatgacctccctgtcatagagaaaggagtctgagcctggctttcaagcaccacgcttgtgcttgcaggctgtgtgaccttgggcaagtcactccccctctctgagcctcagaggaagacagctgttctgcatcagagcctaaggccttagtggctgtggagggaagaacatctaggtggcctccgtgtgactgcacaaaaggtcttgtccttcctcaaagctccaatggaggtagtggtgatggatgtacaactctgggagtctactaaaggctactgcgttttacacttcagaaggatggattttatggtatgtgaattatatctcaataaatctgctattttataaaagaagcttgaggccgggggtggtggctcacgcctgtaatcccagcactttgggaggccgaggcaggtggatcacctgaggtcaggagctagagaccagcctggccaacatggtgaaaccctgtctctactgaaaatacaaaaattacctgcgcatggcggcacatgcctgtagtcccagctactctggaggctgaggcaggagaatcacttgaacccgggaggcagaggttgcagtcagccatctgaaaaaaaaaaagaagtttgaacaagagaccaactctgctaaaaactctgttctggtgggaaatgtgagctttatgaaaattagacttccagaaatgaggaaaaacccctttcctagggggatggagggcgccccccagggttaacttcaggaatgtgtgtgtgaacagaagtgcggtggatgaagggaccacttgcttctcgaaaacaacgtctcgcctttgccacaaaatagcgttgggaaaatccaatgattaggacaaaagaagggcccaggaatctctctccagggacagaaagctctttgaatacctgctggcttgatctataccccatagcatgtccccatcctctgcctgtccgttggatgtaattccagatacctgaggccagatgtggacaagaaatccaaacataagacagcggtgaagaaaaaaaccctgaacccggagtttaatgaggtatgaggggctggtgaagcttcatgaaggccattcctctgccccacagcagtgggggtgtggctgggttttcaaaaggtcatggcgggatggggagggtggtcagagacggtggggaggggccgcaccaagccacagacacaggggagctgggggacccctggaaagctcttggcaggacttgtcggatgtagggctggggggagggaagtgttgaggggagtcctgggttcctcatggaggcaacagggcaaagagggggtgaggaagatggggagaaactctgtgtggggcaaggggactcgagacaccctggggccccaggaagtcttccgcccaaggcggcaagtacagctggaaatgcggattccccccaaggaacaagaaggaaagaagagcagaggggccttgggtagagcccacaccacaccagtgatccagaggcaggcaggggaggtcaagatgcttccagagagtgaggggaaccccggatggaagggagggtcccacagagaagggaggggtcagcaaagccaggccccagagagggccaggatgacaaggactgtggggcgtgcagtgcctctgcagtcaggaggctcccggggtgtggggagagcaggctcagggacaaggagcaagcgggcgaggggacaggggccctgaagaccccagtggagctcagggggaagtgggcgagacatgtgagcatccacccatcatccactctgagcactgatcacccccatccctcctctgtccctacacctcatacccctcctggcccccggcggaggcccaggcccaggcatcagccctaacactcccttcttgccagcaggagttctgttacgagatcaagcatggggacctggccaagaagtccctggaggtcaccgtttgggattacgacattggaaaatccaacgatttcattggtaaggggacatagtgggaacaccgtctcactgtgtgcctgtcctggatcaggccacagcccctctttcctggtccatggggaaagctggagccacggaccacctgcccctaggtcaggggcctcagaccttctccagcctgacccttgtgccccaggaagagacaggcccagggatggaaggagttctgggagggtcacacagcactctgtggtggagcacagacaggagacaatgatgggcagtgcctcgggctggactctgagccctagaggccccaaattcccagtgggcctggtggctgcgcatagtggggctgcccggccctttctcccctcttcaggcccccattccttgacccctgatgctgcctctgcaccctgcccctatccctgccctggtggaagagagacaggatggctgggccctgacggggccagagtgtggcatggaggtcaggtcctgttcatgctcagaacccagcgggcagtgggagaggctggccttcgagcacagaacctgggagggggcatgggccccacgcctgggagttgggggtccctgtgccccagctgcccctcctgtcctcctgcaggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagaggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcaggaagctgggaacaaaccattccaactggggtgagaaataccaagaccagcttggccagtctgcaagtaccgtgggctctgctgactctgccgggaggtcagggacggcttcctggaggaggcggtgcttccgtaaggccttggagggtgagtgagggcttctaaaagcagtccaggcagtgggagtggtctaaaacgcctggagagagaaagccaatggggccggggtgctgtggacccagggtctcctctccaggggagggtttgttaggaaggtgtgaggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctttggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccgctttctctctctgggggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgcttttttgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaagggg

SEQ ID NO: 14418 - DNA, 126468 bp, Human
ctgacctcaggtgatccacccgcctcggcttcccagagtgctgggattacaggcgtgagccactgcgcccggcctgtagttgtgttttttaattgaacgttttgatttcacctttggcttatatttgggcagctctgcggtgtgggtgcttcactgtcatttcataagcaccataccttagtttcaacagaaagtctttgttacatgtagaaagcaaaaatacaattaattttctttaaacctgttttttcaatcttattatttatttatttatttttttgagacggagtcttgctccattgcccaggctggagtgcagtggctcgatttcggctcactgcaacctccacctcctggcttcaagtaattctcctctcggcctcctgagtacctgggattacaggcgcacaccaccatgcctggctagtttttgtatttttagtagagatggggtttcaccatattggtcaggctggtctcgagctcctgacctcaggtgttacacctgcctcagcatcgcaaagtgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccttgcctttcctgcccaccctgttccatattattccgatatgtactgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccaggctggagtgcagtgtcgcgatctcggctcactgcaacctctgcctcctgggttcaaggaattcccctgcctcagcctcccgagtagctgggactacaggtgggctaacatgcctggctaatttttgtattttttttagtggagatggggtttcaccatgttggccaggccgatctcgaactcctgacctccggtgatcggcccacctctgcctcccaaagtgctgggattacaggtgcgaaccaccactcctggccctgtttcatttgttaaacagtaagtaatgtaggatacaatctactcttactggtacctgtttttagtacagtggccttttacaagtttatggaatgaaggagtgagtgatcccattttccttcctaatctgttagtgcttctgacccactctactcttcagattgtactcctccccttggctgactatagttttttcctgatcctccctagccaatcttattctacacagtcatttgtttaacaagcttttttatttgtttgttaagagacagggtcttgctctgtctcccaggctggagtgcagtggtgcgattatagcccaccgtagcctcaaactcctgggcttaagtgagtctcctgcctcaagctcttgagtagctgggattccaggtatctgcgaccatgtctggcaacaagcattttttgagcacctactgtctggctcaaaactgtttctcagctttgcacatcatagttacctgggtgggtttaagaagaaatgggagattttcagacctcacctccagagctagtgaatcatggtgtctgggatgggtggggcttctgtgttttggcaaagctgattctggagtgctggaggatgactcattgtcgtgtgcttccaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcaggtaatctggaggggctggggttcacatggaggctgggcatgagggaggccgaagggttgcagccacagaagcagggctcccctgagctacatacagtgtttagagcttagaggattctgtagaggattctccctgtgaagggctgtttttgcctgcatcacaaaggagggggccgtgaattctagaaatgcaggttcaactctttcctgttggttattagtcaagactgagtctggacagagaatgatgttagagagaggtgagattgttcagatttcatctcagtccaccccttcattttccagtcatccttgtgggaactaaatatccttgtttcctagaactagaagtccacttctccactgcatccatttggggaaagtgtctagaaaggccaaatcctggtgtcaaatttgaatgagcgggaagtaacaccggaaggaaggccacgttggcttgaattctctcccctgggtgctaaggaggaatgtgttcttttttacacatgtgaaacctgagacatagacagttacgggattggccaagtttactgaattagaaagtatctgaatgagtttatctgtctccaaagctcaatactcaatgtgcttactgcactaggtctctaaattacacaggtctggagctgtactgtccgatatcgaagcccctagccacatgtggctttttaaatttaaattcattacaatgaaataaatgaaaacattcggtttcttcattacactagccacatttcatgtgcttaatagccatatacagctaagggctatcatactggataatgcattgctgtctcttagaaagtctaattcgatggcactggtctagaatgtgggagctatgagacatccaccaaataaagacctgtggaatcttgttatttctggcaattagatacacatactgtaattcacagaatatctttaaatgtctttaaagtgttctaagctccatgaaatacagcctagcagtgtgatatcaccttgactaagctttcatgaattactccatttgctgggcttaagcactgtgtactaaagtcacacaactatatattattaactagctgtgcaactttggagaagttacttaagctccctgggcctttttttcctcttgtcaaaaatgagggaaagggttcctgagggtcttaaagatcttatgaatcttggccattattaaaaaggaagttaagcagaaaagaagttaaaaaagaagttaagcaccaaagaaagcaggaaggtgtgtctgtctgtgtctgtctttgtgtattttactgaagttactgactatgtaattaacagaggtcaagatactcttttttctttgcttggattggctgctcatagtatgtccttataatagtttccaaacttttgtttcctttcttttttttttttttttttgagatggagtctcactctgttgcccaggctggagtgcagtggtgtgatcttggctcactgcaacctccacctcctgggttcaaatgattctcctgtcttagcctcctgagtagttaggactacaggcgcccgccaccacacccgactaatttttgtattttttagtaaagatggagtttcaccatgttggccaggctggccttgaacttctgacctcaagtgatccacccccctcagcttcccaaagtgctgggattacaggcgtgagctgccgtgccaggccaaaactttgcttttcataggaaggaaggagtgtatcagaaatacgatctttgtgcttttttttttttttaattttttttttttttttttgagacggagtctcgctctgtcgcccaggccggactgcggactgcagtggcgcaatctcggctcactgcaagctccgcttcccgggttcacgccattctcctgcctcagcctcccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacgatctttgtgctttaagattttaagatgtgtcaaaggtttagtgactaaataatacagggtcatggctaatctggtggattcagctgtggggctgagatgagaaatgggatgtgtcacatgagtaaagagggcaagtcgcagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacgattgtttagaggctgtggtctaatcctcagagtaatttagggctgatggacagttagcaacaatgttaggtgaaaaagtccctgccattctatcttggcagagaagacagcagccatgggtcttcacaggaagaaatacagggaaaggccagtgacggatcagtgtcaatgctggatgtggcataacatcaaggtttgattataaaccctaagatagtggagctttagagaaggactttaggctatgcagagttcagaacgactctcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttatattcatttttcagaggttggatttacttaaaataatttcatggaggtgaatggtaaacatgtatagtggagtacaaaaatatattccatgaaagatcattgttcttctaaccccaacctgcaggtctgtttgtcattccaggatgatttactgcatgtacaggtgtatgtgtctgtttatccttttcatatgtaatataaaatatttgcataattaatatagtggaagtatgttgttcctacttgtgtctaattagcttttttcatttactacagctgagaatttttagtgacctagaattccactgtatagatgtgaggccagccaggcgcagtggctcatgcctgtaatcccagcactttgggaggccaaggcaggtggatcacctgaggtcaggagttctagaccagcctggccaacatggcgaaaccccatctctactgaaaatataaaaattagctgggcatggtggcacacgcctgtaatcccagctactcgagaggctgaggcaggggaatctcttgaatctgggaggtggaggttgcagtgagctgagattgtgccattgcactccggcctgggcgacagggtgagactctatctcaaaaaaaaaaaaaaaaagaaagaaaaatagacgtggaaggctacgatttgaagttatgcagtgagaggtgaaagttgtaggagttgtcatggaatagtaaaacctaccaacctggcacaccttggggcaagttgctaactttctactttctaatacctgatgtctagtgtttactaggtcagtagcttagtgaaatttagtcaacttttatttatttatttattttttgagacacagtctcgctctatcgcccaggctggagtgcagtggtgcaatcttggctcactgcaacctccacctcccgggctcagacgattctctcacctcagcctcttgagtagctgagattacaggcgtgcgcggcgatgcccagctaatttttgtacttttagtagagacagagtttcaccatgttggtcaggctggtctcaaactcctgacctcaaatgattgcccgcctcggcctcccaaagtgctgggattacaggcgtgagccactgcatctggccttagtagaatttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaatctctaaaatctttagccaaagattggctaagactgaccagattaactggatagtctttgaataacgagtgtaaaatatttttgttgttattttcttacatgattgtggatattactgtggaaagaaatagtcttttgaagaaattctgtttattgctgttgcttgtaccagcaggatcagttgttagcaggtacactttttttttgttttttttttttgagacagtctcactctgtcgcttaggctggagtgctgtggcgcgatcccagctcactgcaacctctgcctcctgggttcaagagattctggtgcctgagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccatgctcctatagaatgctgtttgacacagtacttaatgcaaaggtctgcatagttctcttcctctccttttctgtgcagaagctgtcagatgaagggttgcattgtagataattcagttctgcatgtgtgtcctttgtaaggacctgaatgttatctgtcttggggccctcccttttggagcaccggggacttccatccacactcacattcaccctcccccagatcaaaccacctcgggcccccctgggcagctccagcctcttctgtggctcgtggcccagtttcagtcacctttcccctgttagaaggatcagtcaggtctgtgtctaatattgaaggggcctttccttcacttttcttcagcagttactccacttggagagcacacagtgagagagcacacgccagttgggaaacacattgtgtcgtatgtttaagtgcttaaaagttcataaaacatgaaatgtgttcgtttgaaaatggaatagtatcccatgcagtttttacaagtaagagatatggctggtgaattcacaacggaagatagttgtttaaattaaaaaaaacaattttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtgggattatttaaatttaagataacattttaaacattttagagttttttgcaaatttttattttattttaaatttttgtttatttaattaattttttttttttttgagacgaagtcttgatcttgtctcccaggctggggtgtagtggtgtgatctcggctcactgcaatctccgcctcccaggttcaagcgattttcctgtctcagcctcctgaatagctgggattacaggcatgcaccaccaaacctggctaatttttgtattttaaattagccactcccactaatttttatatttttggtagagacagggtttcaccatgttggccaggttggtcttgaactcctgacctcaggtgctccgcctgcctcggcctcccaaaatgctgggattacaggcatgagccaccaggactggccatttatttagaggcagggtctcattctgtctcccaggctggagtgtagtggctccatcatggctcactgcatcctccaactcctaggctcaaacaattctcccacctcagcctcccgagcagttaggactacaggtgcacgctatcatgcctggctaatttttaaaatttttctttctgtggagacagggtctctttttgttgcccacgctggtcttgaactcctggcttccagcagtcaggagttgaactcctgcttcagctcccaaagtgctgggattacaggtgtgagcctacacactaagcccattttttttttttaatttttcaagagacagaggttcgttctgttgcccaggttggaatgcagtggcacaatcatagctcaccgtagcctcaaactcctggactcaagtaatcctcctgcctcagcctcccaggtagctgggactacaggtgcgctacatgcccagctaattttattaatttatttatttttgggaaacagagtctcactcttgcccaggttggagtgcagtggcgtgatcttgactcactgcaacctccactttccagatcaagtgattctcgtgcctcagcctcctgagtagctgggactacaggcgcatgcaaccatgcctggctaatttttgtatttttagtagagacagggttttgccacgttggccaggctggtcttatctttggagttttctaatgttgtaaagaaggaaatactttattcaaataagcaataaaagcgttttatacaaattggattgagactttatttttgaaagagtctggccacttaagtgaaatgagatccgtttgattttagacagctttcaattaaagctagaataggaaatgatattagattaagaaaaacttttcagataaaaacattcccaaattttactttcaaattaaacaaattttcagagtttctagcaaaacaaaactcctttttttttttgaaacagagtctcactctgtcacccaggctggagtgcagtggcataacctcggctcactgcaagctccgcctcctgggttcacgccattctcctgcctcagcctcccgagtagctgggactacaggcgcccgccgccacgccaggctaattttttttgtatttttagtagagacggggtttcaccatgttagccaggatggtctcaatctcctgacctcgtgatccgcccgcctcagcctcccaaagtgctgcgattacaggggtgagccaccatgcccggccagggactgatggctttgatagcctattttagatagtgtctcaattttgtttatctcagggatagtctttgcttatatgtcaagtatagcagtttaattggtcagatagaaactttctgtggatagtattttaataaagcaattatgaaaacaaagtacgtaggaagtaacctacttgtctacctttgactagaaaggaaatttagaaaacatctagagccaggaaacgtaaatacaggggttaaagttacaaataaattttataacagcatattaaaaaacaaaaacatttgattggtttacatctgtgtctcccttgtgaaaatctaatctttaaggacaaacactgcattttatccatttctgtatagtacagtacctggctttatagttaatggtcaataaaccattgctgaatgaataaatgatggttaaatttgaagctctattttaaaatactaggtaagtgatctgaacccacctgtagacaccagagaataaaactattgatgttcagtgtacatttttgttctgtgatattttaaacatatatctgaattttttttctttttgagacaacgtctcgctttttagcccaggctagaatgcagtggtgccatcttggctcactgctgccttgacctcctgggctcagcaattcttccacttcagtccccaagtaccttggactacaggcacgtgccaccactcctggctcattttaaatatttttatagagatggggatctcgctgtgttgcctaggctggtctcaaactcctgggctcaagtgatcttctcaccttggcctcccaaagtgctgggattacaggcatgaggcagcatgcctgacctctgaattttttttttgagatgaagtcttgctctgtcacccaggctggagtgcaatggcatgatctcggctcactgcaacctctgcctcccaggttcaagcgattctcctgcttcagccttctgagcagctgggattacaggcgcccgccaccatgcccagctaatttttgtatttttagtagagacgaggtttcaccatgttggccaggctggtctcgaattcctgacctcacgtgatccacccgcctcggcctcccaaagtgctgggattacaggtgtgagccaccgcgcccggtgacctctgaatttttaaggtgattaaaaattcaaatgtagtttaacgacttaagatgtaattcatataccaggtaattcatttgtctcaagtgtacaattcagtgttttttagtaaattcacagggttgtaccacagtcacaagaatctggttttggaacatttcagtcactccccatgtactcttcgctccagccctaggcagacactaatagattttctgtctctacagaggtgtctattctggaaattttatataactggaatgataagatgtgtaaccttttgtgtcttacttctcttacttagcctgatgtttctaagtttatccatgttgtagcatgtatttttaattattattgttcctttatattagtaatatttcatcatatggatatataccacattatttttctgtttatcagctgatgaacatctgggttacttatgggttttggctattatgagtaatgttgctgtgaacctgtgtgcaagagtttttgaatgaatgtatgtttcattctcttgggtatataccaagtagtggtgttactgagttttatgttaactctgtccttaacgttttgaggaactgccacacttttccaaagaggctgcactattttacattcctaccgacagtctatgagggttccagaaaattgaaactaagtttttttaagttacaagggaagatgcctttatcctagcaagctacaggtaattaaaaccctgcgagagtctctcatgacaagtttagattatgaaggattctttaggtttgcattttattatcaatagatacatgttaatattcaggctgggtgtggtggctcacacctgtaatcccagcactttgggaggccgaggtgggtggatcacctgaggtcaggagttcgaaaccagccatggtgaaaccccgtctctaccaaaaatacaaaaattagccaggcgtggtgacacatgcctgtaatcccagctactcgggaggcagaggtgggagaattttctgagcccaggacgtggaggttgcagggagctgagattgctccactgcactccagcctgggtgacagagcaagactctatctcaaaaaaaaaattatatatgtgtatatattgaatataatatgtatatatatattcagtctttgaaaacgttcctttcttacttgtcacagagtttatattgaaaggaacagtatttgtggaagtaaagcaattcataaagggacctggagagagtttttctttgctgtagctgtattattggttggtagaaatattggtatctatatgaagggctaaagtaacattttggactttgggtgacatgtgtttcctgaaaacgagggagcaagaattctgttgccctaaaacttggcaggaatagttttaatctgtgagtttctttttttttctattattatactttaagttttagggtacatgtgcacaacgtgcaggttagttacatatgtatacatgtgccatgttggtgtgctgcacccattaactcatcatttaacattaggtatatctcctaatgctatccctcccccctccccccaccccacaacaggccctggtgtgtgatgttccccttcctgtgtccatgtgttctcattgttcgattcccacctatgagtgagaacatgtggtggttggtgttttgtccttgcgatagtttgctgagaatgatggtttccagtttcatccatgtccctacaaaggacatgaactcatccttttttatggctgcatagtattccatggtgtatatgtgccacattttcttaatccagtctattattgttgtacatttgggttggtttcaagtctttgctattgtgaatagtgccgctataaacatacgtgtgcatgtgccttttaatctgtgagtttctaaaattggaaaaccactgtcactcttctggggagtgaaagagaaaacccgagagttggtgaaaatggacagctgtccttcatgtggccagtgggaagagggcagttcacaaagactttcagacctggttgtagcattggggaacttttacaggtggtgacactaggtattgtccttgtattgtgctgccttacgcttgctgccatagggaacttttggaaggtcacaaaggtcatctgtgtcatcagtgtcacttgcttactcagcagcatccccctggagttctttgactcacatattcctagttacttggtggtttgaggatcctgtcctgttgatcacccctcaggtacctacttacttttggagtcttgtgaatgcctttttgtcctctttttatattaattaacttatttttaaaaactctcttttattgtggtacaatatgcacaacttaaaatttatcattttaggctgggcgcagtggctcacgcctgtaatcccagcactttgggaggccgaggcgggcagatcatctgaggtcaggagttcgagaccagcctgaccaacatggcgaatccctgtctctactaaaaatacaaaaattagttagacatggtggtgggtgccagtaatcccaactacttgtgaggctaaggcaggagaatcgcttgaacctgggagtcggaggttgcagtgagctgagatcgcgccattgcactccagtctgtctcaaaaaaaaaaaaaaaaaatatatatatatatatatatatatttatcattgtaaccatttttaagcatagagttcagtggtattaggtacattcaccataatgtgcaactgtcaccaccatccatctccagaacttcccagacagaaactctgtacccattaaacgattatttcccatttacccctctcatgaactaacttatgactgaggccagtctcttatgcaagcccagctttcttgaaagttccctggcttctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaatagggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagtcctgaggttttaggttttatttaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattagttcagtgaagcagattggatttatcaaatggcaataaatgtttgctgaattgaattgatctctgctggagagtttgctgtctgagcaagatttcctccctcactcttcttactctgttttttcattttacttctttattcgttcaacaaatgttcattctatggctgcattgagccagatcctattctaggtgcaggatatatagcagtgcatatatctctcacatggaccttatatctcttgggggctgccagggaagacagttgataaacaagtacatcaataaataagatatttgcagtaagtggtaagtgctgtaaagaaaaacaaagtgatatgatggatgtgaccaaggggacacgggctgttttaaatagggtggtcaaagaagggaggcctctctaaggaagttaagtcagagctagtcccaaatgacagtgagccattctcatcaagatctggggaaagagcatttgaggaggaaggagcagcaaggtgagactgtgctgaggcaggcagctgtgagcctgagtgctttgagcacagggtgacaccagtggggttgtgtcatgggctcatagcagaagggcgcacagctgcctgtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttccgcagtgtttgtgtccctgggtacttgagattagggattggtgatgactcttaaggagtatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacagtaacaatctgatctttcttttccacacatttcccccttttctattcgacaaaaccgccattgtcatcatggcctgttctcaatgagctgttgggtacacctcccagacggggtggcggccgggcagaggggctcctcacttcccagaaggggcagcggccgggcagaggggctcctcacttcccagacggggaagccgggcagaggggccccccacctcccagacggggcggctggccgggcaggggctgccccccacctcctggacggggcggctgctgggcggagatgctccccacttcccagacggggcggctgccgggcgggggggggctccttcagacggggcggccggtcagagacgctcctcacctcccagacggggtcgcggccgggcagaggcactcttcacatcccagatggggcggcggggcagaggcgctcccaacatcccagatgatgggcgggcgggcagagacgctcctcacttcctagacgggatgacggccgggaagaggtgctcctcacttcccagactgggcggccgggcggaggggctcctcacatcccagacgatgggcggccaggcagagacgctcctcacttcctatagggggtggcggccgggcagagctgcaatctcagcactttgggaggccaaggcaggcggctgggaggtggaggttgtagcgagccgagatcacgccactgcactccagcctgggcaccattgagcactgagtgagcgagactccgtctgcactcccggcacctcgggaggctgaggctggcagaccactcgcggttaggagctggagaccagccccgccaacacggcgaaaccccgtctccaccgaaaaataggaaaaccagtcaggtgtggcggcgcgcgcctgcaatcccaggcactcggcaggctgaggcgggagaatcaggcagggaggctgcagtgagccgagatggcggcagcacagtccagcctcggcatcagagggagaccgtgcaaaggggagacgaggaccgtgcaatggggagggggagggggagggggagggagattgagatttactttcttaaaatatctctgctcttgtgtggtggtgtttgaagggaactgggtgagagattgatgggaaggttgtgctgttgtccaggtgaaagggagagctgcttaggctggggtggtggcagtagagatggaaagaaaggctgggacgggaagtctatactgggggtacgttgaagtgtagttttggtgggtgttgtcaatggtattcccttctgagagtggctgctacagcgcagccagcactaggtggtcggggttttcctagttaggtgaggttatgtacatcagcgtggtcaggtgaataacggcctcccaaaagatgcctgtgccctaatccctggaacctgtgaacttggtaccttacatggcagaagggactttgcaaatgtgattgagtcaagagtcttgagatgagtgagatgatcctggattttccggatgggcacaatctaatggcatgaatccttaaaagtggagagctccctgggtgtggtagctcatgcctctcatcccagcattctgggaggctgaggctgaaggattgcttaagctcaggagtttgggaccagcctgggcaacagcgagatcaggtctctacaaaaaaaaaaaaaaaaaaaaattagccaggtgtgggggtggctgcttttagtcccagctgcttgcgaggctgaggtgggaggattgcctgaccccaggatttcaaggctgcagtgaacagtgatcatgccactgcatttcagcctgggtgacagagtgaggccacgtctcttaaaaaaaaaaaaaaaaaagggcaggggaagtgtggacagaacctttcctggctgcaactagagatgccatgacagaagacacaggagagtttccaggcttgacagagacttgacctgctattgctggctttgaaggtggaggaagggaacccctcagccaaagaatatgggaggcctctacaggctagcaacagccctcagctgacagccagcaaggaatgggacctagtcctactaacacacagggagctgaattctgccaactaactgattgagcaaagaaacagtccctgctagaggctccagaaagaaatgtagccccacagacaccttgacagagactggcgtcagatttcggacccacagaactctaagatagtcaatttgtgtcatttacgccactaaatttctggtgatttgttaacacagtgaaagatgactaatgcaactggtatagtttataatctagatttcccttgttagtggggttgaacatcgttccgtatgtttaaaggccatttgtattttattctctgaaccatctatgtcctttgcccatttctctattgatcccggccaacatcaagaatttccttatttattgtggagattggccctttttgatatgaggtgcaagtttcccccgactatttggtattttaaaccaggaaactatatgagactggcgggggacagactgcggggtgataagagtcccaggactgagtcctcgtcactgcactctttggaggacaagcagaggagcagagaagcctgtaacttttccacttcctgttggtaggccattcttcagtccaaatgaaaatggccatagaatggctaaaccaatgtgttatttgtattcttttaacttcttcttcttcttttttttctttttttttttttgagacagtcttgctttgtcaccaggctggagtgcagtggtgtgatctcggctcactgcagcctctgcctctcaggttcaagcgattctccacttcagcctgccgagtagctgggattaaaggtgtctgccaccacgtttggctaattttcatatttttagtttcaccatgatgaccaggctggtcttgaactcctgacctcaggtgatctgcccgccttgtcctcccaaagtgctgagattacaggcgtgagccaccatgcccagccagtactctttttttttttttttttttgagacggagtcttgctctgtcgcccaggctggagtgcagtggtgcgatctcggctcactgcaagctctgtgtcccaggctcatgccattctccttcctcagcctcctgagcagctgggactacaggcgcccgccaccatgcctggctaattttttttgtatttttagtagagacagggtttcaccgtgttagccaggatggtctccatctcctaaccttgcgatccgcccaccttggcctcccaaagtgctgggattacaggcgtgagccaccgcgcccgccagccagtattcttttaacttctattcctcagttcaattttagctatgagtaggtctcaagttttaagccaaaagcttcaatgactaaaccatttcatagttatggtttggaagttttacagttccattcattatataataaactgtggtatggccgtgatgcaggaatggggagatatactgtccagtcacatattctggtttctagaggctaatcttattcttaccagtgtggtcagtgagcatggaattagaatgcacgttaccttcagctatctcagagtcattttactgtttgcgttgatgtggaatgagcattgtcattattcctgcatgacgtttccaggttttccctgagagaatggtatatggcttgatcaaagttctcgaatattgaagacacctgggaaaagagatttgttgttatcttgataactttatacctggaaaggactctcagtgaaagaacctaagatctggagtcaaaagacctggctcagtttctcaccacctctctgattttcagcagttcatttaactttgtctgtttgttcatttgtgaaatgaataaaataataatatctatctaggatatcttgtagaattgttagagtgctcatttttttcttaagatatgtatggtacttaatttttcataaatatatatgatatatatgaaatataaggtatttatgaaaaatacctttgtacactgtgatgaagtacatgaacaagtcatagagctcacatttcagatattaataggaggagcagatgaatgagcccggatatgatttatcctgtagcaataaacaagtttttgcaaaaatgaagctacctgaacagatacaacaagaattacatctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggagttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactctgagattgggacgttacctttagcagaacaggtaaagcaccatcaatgcacatttagaaatcgtcaggacattgcatatcagatgaagaagcaggaggcatcagcactggcctgcgggtgggacaagggaatgtcataatatttcagaccccttgacgtcaccacctttaagaagcaatatggggaagctgaactaggtgtgtcacactgtgatccattgtaaaagggactcatttacctcatggtggggatagtattttaaagtgtttagtttcagaagttttccttcttgaaaacactcaaaacttgtgtttacttgaaaataaacagtgtcagatttttcattaggggcaaaacagaaagcaacgagagagtctcaaggacgctattgggctgatacactgataccaaatgcagtggatgggcaaggaagtaacaagcggaagcaatgtatgtacacggtgcataattcctctttagtgagtttgagatgtgtgtgagactgtcccatggcttcccaccccaggagctgctaccttgtagagtccagtcatccacttgatgagggtggtgttcattttccttatcaccctctccctcaatttttatctgagagatggaattatgagttacaggaggaaggagtaagaggcacatcaaagcctttttgtgtggctttgaataagcggccttattggtttggggttgttagctttgggtgtgctattttcatcatgaagcacctggggtttgtttttttctaaaagatgtagataaactagagagaatccaggggaagggcaacaaaaatgatgtatgacttggagagaaggagaataacagtctataaatatttgaaaggtaatataaaagagggagagagattatttacagcagtggagaggagtttgacagggaacaaaagcatgcatctaggagcagggggaaattgggtaggactgaaaaaaaacaaagcataataagggtgattaagcaaagaaatgtaattctcacattagtttgtgtttccaggatgcaggatggtaggaggaagaagtgacgtttgtcaaactgaagatccacacacgactatgaatcacgttttcctaattcctctctgggaagccaggagagcgggcagtgctttattctgtgcctcctaagcatgcagtcggtttaattctcaactctttggcattatgttttcataggtggtagtaataattataacccgagtagctctcatttaccgagtgtctgccttgtggcaggtgttgtcttagctgctttgttatttatattttcatttattctttacggcaactctgtaaataggaagtatgtttttccaattatagggaaattgaggtttagtaacttccacaagatggcatgtgtattaagtggtggaggtggaactcaaacccgggtctgtgacccacagcccatgctcatgccctacatcgggctccattactctgtcattgtggtcatgagagtagtaactgggacccagtaggtggccaggtggtttgtatcttggtacaagggtaagtaaaatagttgatgtccaaggctccctttgctttctttttctcttattttcctttcttgagatatattttctctgtaagtgctgtgttattaacatactacattttatcattctgtaaattaagttatactatatgcttttagtcatctttgtggttatatagtgatatgtacaatctcacttaggaaatcaacaattgttgttttttattttgagacagggtctctatcgcccaggctggagtgcagtcgtgtgatcacagctcactgcagccttgacttcctgggctcaagcagtcctcccacctcagcctcctgattagctgggactacaggcgcaagccaccatgcccggctaagttttgtatttttttgtagagatggggttttaccatgttgcccagggtggtctcaaactcctaagctcaagcgatctgcctgtttctgcctcccagagtgctgggattacaggcgtgaccactgcacctggcctgaaagaaagtattttacaaggcaagcattatcctggatcttacaggggatctcttagctgtattctatatttgcctcagctttctgtctctgatatttgataatatccggtgtattgatgattgctttaaaaaaacaaaattcacagaattcttcactacttagaataaaagtgaagagctgtgtgtctgggtttttcatgtcattgcaagaagttaccaaacctggaatcaaaaggcctgggtttcaatcgcagttccagctatgtttctttgtgtgctgggcacctttctaagcacagctagctcctctgtcttgggccattgtacctcctggtcttcaaccttacaaggttatcgtaggtagcgtttgaaagaatatacataaaatgttgtttatgaattgcagagtatacttaaatgaaaaatgttaagtttaaaagttagcatcggctgggcacgttggctcatgcctataatcccagcactttggaaggccaaggcaggtagatggcttgagcccaggagtttgagatcagcctgggcaacatggtgaagccccattcctacaaaaaataaaaaaattagctgggtatggtggcacacacctgtggtctcagctacttgggagatgcaggtgggaggatcacctgagcctggggaggttgaggctggagtgaaccatgatcgtgccacctcactccagcctgggtgacagagtgagacactatctgaaaaaataataataataaaaataaaagttagcatcctttatattagcagcttttttcttagtgcagcttctcttggtaaaactctgatatagtttagggatggttgaggcttctgaggaagttgacatccaaaggaccttgttagatttttatccgggggcggaacagaaagtactaagtgaatttcaaggatattctactaaggccacagcttttgcctcttcctcccctttccctatggtgacatgcaatggagaccatgccagatcttaaaggtggatggcatagaaatcaaaatgtggctcaaggcattggcatgttcatctacacttgcattgtgaatacaaaggtgtactcatctgcacctttccatttgccagttctcctagctgttctccgtaggaattaccttccctttggaattgtgtaccttttaaaattcagaactttttgaatttccgtctccgggtcattgctcctagttgttgtctctagtgaattcttctctaaagtatccctagattacttttactgtaaactgtaatgatttgactctggccatatttctcccaaggtctcctatctcggttacttgtaaggctactcctcccctctcttgttctctttgatcttttataattggcttaaagctctctatatttaatctgcagtgactttgtttctcctccctattttggctttttcaatccctgagaatttaataatctgtttctcattattttctattttttcttaaggtgtcgcattctctgtcgcacagttaatagtcttttctcctcttctccccatttggtttatattagctattaatgcaagtctgcattgtgtctctattttggcttgtaataaagtcctgtgtattctgtggagttggtgggcgtcctagttacagacttggctgaacctgaagacccctgcacgtgtatatggtaatgttgtaaaaatacggccctggagataaacagttgagcacccagtttgtattgaacgaataaatttcttaagtttttgagagctttctcttagaagttgaccttttgggggcaaattactgtgactattcaacatgtaagaaagaatagcttgccgggcgcggtggctcacgcctgtaatcgcaatactttgggaggctgaggcaggtggatcacctgaggtcaggagtttgggaccagcctggctaacacggtgaaaccccgtttctactaaaaatacaaaaaattagctgggcgtggtgacgtgcacctgtaatcccagctactcgggaggctgaggcaagagaatcgcttgaacctgggaggcggaggttgcagtgagccgagatcatgccgctgcactccagcttggacaacaagaatgaaactctgtctcaaaaaacaacaacaataacaacaacaacatagctctggtcgccatcctgtggcctgtggttgaccttttgatgagtccttcccgtgacagcatccgtcataattttttcactaagcttagctcttcagctgtgaaatccttttagccacagcattgtagtctcttctcagaaggttaagctttctgatacttttttagtctgtcacttttctggtctctgttgggtccaagaaagaacccctggtgagtctaaaggctttgcttattttgttctttaagcttaggttcccatatttctcattttcttgacttttttttttttttttttttgagacagggtcttactccattgcccacgctggagtgcagtggtgtgatcatggctcactgcaccctctagtcctggggctcaggtgattctccaacctcagcctcccgagtagctggaactacaggtgcacaccgccaagtgtggctaattttttttgtgtgtatgtagaaacagggtttctccatgttgcccaggctggttttaaactcctgggctcagctgatcctcctgacacccaaagtgcggggattacagttgtgagccattgtgcccatacattcaagccttttaaaactgtattattgggtttcagggggtctttgaacccaaggtctggctctgttgcccaggctggagtgcaatggggcaatcatgggcacattgcaaccttcgccttctgggctcaagccatcatcctacctcagcctgagtagctgggactacaggcgtgtgcaccaccatgcccggctaattttttgtagagacggggttttgccacgttgcccaggctagtcttgaattattgagctcgagcaattctccaccttggcctcccaaagtgctgggattacaggcatgaaccggtagcccggctggtctttgaactcttttttttttttgagactgagtcttgccctgtcacccaggctggagtgcagtggcacaatctcggctcactgcaagctccgcgtcccgggttcacgccattctcctgcctcagcctccagagtagctgggactacaggcatgcgccaccacgcccggctaattttttttttttttttttttggtagagacggggtttcaccgtgttagccaggatggtctcgatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaaaagtattaagaaccactgctttgagtttaaaacgatggcccttttccaacaactaccatttcttgttatattttcttcatctctctatatacctatttacatttttctattgatttctgagtaaataggaagcagactttatattatttgagacccttctaaaaataacttactgaggtataatttacatgccataaaactcaccatctttttttttgtgatggcatctcactctgtcacccaggctggagtgcagtggcttgatttcggctcactgcaacctctgcctcccaggttcaagggattctcctgcctgagcctcccgagtagctgggattacaggcgcccgccaccatgccaggctaattttttgtatttttagtagagatggggtttcaccatgttggccaggctggtctcgaactcctgaccttgtgatccacccgccttggcctcccaaagtgctgggattacaggcgtgagccagtgcgcccggccaaaactcactatcttaaggtgatgtttaatatattcacagagttgggtaaacatcaccactatcaaattttaaaacattctcataccatctccaaaaaactcatacccattactggttactgggtttcttcccccagcctctggtaaccactagcctactttctatctgtataggtttgcctattccagacatttcatgtaaatggaatcatacactgtgggattatttgtgtctgacttcttccacttagcatgtttttgaggttcatccgtgttgtagcatgtttcaggacatcaggacttctttttattacttatcagtattttattgtatgaatatacaacatttcgtttactcatcagttaatggaaaacattttatgttcaaatttttgtgtaaatatatgtattctcttgtgtatttacttcaaagcggacttggtggttcatgtggtgggtctgtgtttaacattttgggggactgctaaggtttttcaaaagcgggtgcaccgttttacatttccagcagtgtgacatacatttacacaaaaatttgttcatctgggccagctgattggacgatgtccccccacattaaaggcagatcttctctactctgttcatggattcacatgccagtgtctttcggaaacactcacagacacaccccagaaataatccttgagcagtttgctaggtaacctttaacccagtcaaggtgacatctaaaattaaccatcacaccatcctagtgagcacgaagtggtattatttgtggttctgatttgcagtttgctgacggctaatgacgttgtgcatcttctcatgcactttgtgccatttttgtctgtcttctttagagaaaatggttattcaagtcctttgcccatttgtaagttttttttgtttgtttttttaagtttgaattgtaaaacacatttctataagcattttttttttttgagatggagttttgcgcttgttgcccaggctggagtgcagtggcgcaatcttggctcaccataacctccacctcccgggttcaagtgattctcctgcctcagactcctgagtagctgggattacgggtgcctgccaccacgcccagctaattttttgtattttcttttttttttttagtagagatggggtttcatcttgttggccaggctggtctcgaactcccgacctcaggtgatccacccgccttggcctcccaaaatgttgggattacaggcgtgatccaccgcgcccagcctctatagacatttaatgttcttaggttatcgctaggtcttgtgaatgagtgaaataaaggaagggaaaccctttagcttggcagtggcaaaggtgaggtgaaaggcagtggaaaggtgttttaataactgggggaatggccttctaataccttttaagtattgtattgtccatttggagagactaaggctaaagatgacctgcagggagagaacagacaatgcatagatttggaagtgagaaaaagaaaagaagagaaaaagttcaccttctagtactccccccaaaattcaattagtaggggaaaagaaatataggaagtgggcatatttaacttggaagtggaaagtacctaaaagctctcaaggaaataaattattcctacagagtatggtgaccatgtattttgtatttctcttaagattaaacgaggaaacaaatttaaaatgtagtccttttggtaagtgagattttagcattggcatggtgctctctcagctttgaataggggatagaatctcttttctcctcatgtgtatgattctctttgaaggtaatgaatgagtcaacaatacctcttgaaattttttcccagtcttgagattctattaaatcattttgttttgttttttgagatggtgtaagttttgattcatggatcagaacatcaggatcatttgaatagttctcagaaaaatcatagcgccttcatctaatatttatacagttgagatatagattgggtccctttttatatctagatctagttcttgctttgtttccccttcattgtcattttcagccctttatttgtttctgaacttgtatataagtttattttacacaatcttaatatatacagcaaatgtgtatgaggcacacacaagccttaaatacatgtctgtgcatgctatgttagatattcttgttaatgatggcaactgccataaactccctgctcctagttagaaaaagggccatgatgcctgaaaggaatttggaacaaagcagtacccctttcttcaaatcttgatgccttaatttcttgagtgaaatttaggtatgcatcctctctgtggacacaaaaggaacttccttcttggctgtcttggccttccttcctctcttcttgggacttgtcataaccctgtattaaaaacaataacaacaacaacaagttaatcttttttttttttttttttttttttgagatggagtctcgctctgtcaccccagctggagtgcagtggcgctatctcacttcactgcaagctccacctcccgggttcatgccattctcttgcctcagcctcttgagtagctgggactacgggtgcccgccaccacgcccggcaaattttttgtattttttttagtagagacggggtttcaccatgttagccaggatggtctgaatctcttgaccttgtgatccacccacctcagcctcccaaagtgctgggattacaggcgtgagccaccgcgcccggccaacacttaatcttaaaacctgtatatttgtaggagtatgtgcttgtcgttctgatagtggcccttccctcattgtaaattttaaaaaacatgtctttattctcttactcttaaaaccagtattgtttccgtggtggaataaaccttgagaattgtgggtgaggctagtggttgacgcagttacagatgataccaggtgctgcccacagactttgcaaactcactttccacagatagggctcccagacctgggcctgacagctttagagtctttgtccttctctgacacaggctggaccctccccacagagattttcctaggttctgcatctattttgattactgtcacatagtttttgatacttgagaggtatcaagaccttgtgaggtaaaatttcagaaagcatgttaggtttctggtgatccagatgtacaaattctgtacaatgaagatcaccaaatgaggaaaatgaaaatatatggatgatggtgtgactatagttgtgggccagttagatagcttctgtcatgctgtttgtgtcttggttgccatagagacattttagctaacaagcccagcatggctctttgtagtcatttctttcagttcagatttgattttcttttcaggtaagattttgagacacgtgcatgtgtgtgtatgtatgtatgtatgtgtacgtatgtgtgtgtgcatatatagtgtatgtacacacacatatatatttacgctcatatcccaagttaccagagccttcagggcttttgaactgctggaaaatagctgcgtccggtgtttaaaagccagaagcccctgtctctggccaaaaagaggtgccacatgtgattggcagagctgtgtcacctgcctggctgggaactcgagttcccgcccctacactggggatgctggagttgacacagtatggcatgctttgctgcacccttttatccctgtggttagtggtagatttggtggagcagttagccctagggacacaattgagagctgggtgacaggtcttcttacctggttccgagtagcttgtgtatatcctttgagaacagcacaacatagttaggttagcagcagctggcagtgaggctgcagtttccaagtacagagctgaacaagaagccagaatttagagggagctgcttccaggataaggtagaagagccacaagtcaggggctttgtgccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagagatggggtctcgccatgttgctcaggttggtctggaacttctgacctcaagcagtcctcccgccttggcctcttgaagtgctgagattacaggcatgaccgctgtgcccaggtaacaggtgtctgagaatgtctatcagccagactccacggctcccttttccccttctgacacggcatggtagacaagtgtgaggtctcagaagaggctgcctcagccatggtcccacttccagttacatgtgtgtcctcagacttgctcagaagaggctgcctcagccatggtcccacttccagttacatgtgtgtcctcagacttgccacttgaacctctctgggtgtagaaacaagggatgaaattacctccaaggacttctctgtggtcacattctgtgaaaggctattggatttaattctctgtggttcaccttccctgactttggtaaaaatgatggttgaaagaatggatgaatttttatttgtagaatcaccttcttttaatgtcaaagaagctttattccaaaggaataaaaaaattgagtggtctcgttcccaggatatacatacactctgctgaacaggttttgaaccgtgtaataccttagaggtatgtctcacccccctggagggtgcagtaagggttctgaaggaggcgatggtagaggagacaaagaaatgccagcaagtggctaagcatttggtgggcacatgtatggccagcaaccctgtttgcaccttttctttccctgctatttatgttgaaaagcaagctaaatgtaaagctgcactttttgatgtagcactagatgtcaattctagcattaatattttgaatccatagggaatctgcacatctcatttcagtcactaatttgaacagaactcctcctcccattccaaaaaaagaagctaaatatggaattgtatatattgaatttaagatgtaaagtttctctgtgtctctgttcactttcccagtagcagtctttaaaaagcacgatacaattaaacagcagaatcaaaggaaagggagtataaagggctccagataattcccagtttgggttatcagctcccacacaatggagagttgattatttttcctttattttagggaaggtaaaagtccatggaggtgagaaaagtacacctggaagagatctgaaatattcctgattctggataagtgtgcctgtacaatgacccatggttggctttggaatataccattaaagtactggaggtcagaaaagcttccttcacaaatttggttaggtggagcaggttgctaaaacatccagcaaccctggaggtcatagaccacgctaggagaaataattatgcatggtaatgggcaattacagataatggccttccgggggtggcagaaaatacacagccccacagccttgcctggaatgaacattgaatagcacattaactttatagcaagctaaaagttcagccctggaactgcagctgctgcccccccccccacccaataaaaatgtctgcctgtcttaaggtaatcacaggagtggctgcacttctcaaaagcagagtcgaataaaggaggagatgggactgtgggagacagactttggaaaagggaaggaatggtgcactctactccactgggttgcatttgcctcactaagtagaggtggtggcttgcaggaggtgcacagtaagcagttgttgctttcctggcgccaggtttgtgtttgacgtttaaaatagccctgtcatgattgccttgtgggagaaacacattgttcccgcatttcctgattatgactttagggagtaatatcacaccaaacgcactcaaggctactgtctgacctcagagaaggccaggagtggaagattccaagttcagctgagcttgggaagcctggccaggtgcagcccagccctcctgcagtaccctaatgatgaggatttggagcaaggataactttgtgcggagttatttggtggctctcttgcttgatggcagaaaacgttatggccgtgttgtgattgtgataacaataatagctaacatttattgagcactcaacacgtggcagagcctttctaagtacatgtcttctctcatataattctcaagtagtagtagtatttctttgctacgtgcaaaggctgggacatgcaaaacgtatataacttgccccatgattgcatggcattagatttcagatccgatcaattacttttgcttgggaccagtgctctcaacctgaagttgtgctgcctggccatattgtgtcattcttaatgcctgtttcatggaaagaaatatttcagacataaggataaagccagagctgcctggttaggactttattgctgtctactaataacacaaccctgagagccagctcagaataagatgccaggctctaattctctcaaatcagtccccctaaaaagacaggggctgttaagatggaagttctcaaactttttacttgcagaatctctctacaaccttaaaaagtattgaggacctcaagagcttttatttatgtgggttatatctatcgataccatactggaaactaaaattgagaaatgaaaaaaaaattatgcttttaaaataataaactcattacctcttagcatacgtaacatacttcaataaaaattactacattttgcaaattaaaaaaaaacaagagagtggcattgtttcacatttttgcaaatctcttttacgtttggcttaataggatgtaggtgggtttgcatagctgctgcttcaggtaggctgttgttctaatggaaatacaggaagaaaattcagcttcacgtagatagttagaagaggggtagaagtattttaatagccttttacatcattgtcactattctttgatactagaccaaaacttgacaagtggtaattgcttaaagattagttgtgatgtggaaaccaaaaccatgctaacgaacattttgtactctgtttcattaaaatctattcatctgtctcagacttggcttccaagatcagactagatctgctggtgcgttcaaggtggtatggccatagactctcttatactttggatggctctttcatccgtgtatgactttataacattatgcattggtcatttgggaaatactacttcagtaagttatgtacaacttccaaatgttgacacattttattacaaaataccagaaaatcacattcattaatactactgctgatcttgttagaataatcttcaagtttggaagctgtcatccacatagtggggggccataaattttctaaaattctaatttttacttgaaaactcaaatttcggcaataaatactgtcagttgttttccttgaagtgacaggctcacttagttcattttcaagagaatgccgccaaatatctgagtttcagtaattgtagtttgtcatcagtcactcttccaggatatggtgttcctttaagaaaaagcagtgagtgtagctcttcaacagttgcacaaatgtcctttttcctttggtgtgcagaaaggctgtgtgagtccttcccattgagtcacacagtttttaaaaagacgtgtactctgaggtacagatttgatcaagttactctttctttctgcttcatcaagggtgtctttagcaaaatcaacataacatttttttaaagttttaacattttccttcatagcgatgaggaatatgcgagcattagtatacttgggtagcttgggctgggcgtggtggcttacacctgtaatcccagcactttgggaggctgaggtgggcggatcacctgaggtcaggagttcgagaccagcctggccaatatggtgaatccctgtctctactaaaaatacaaaattgcctgggcatggtggcgcatgcctgtaatcccagccattcaggaggctgaggcaggagaattgcttgaacctgggaggcagaggttgcagtgagctgagattgtgtcattgcactccaacctgggcaaccagcaaaactcagtctcaaaaaaaaaaaaaaaaaaagaaaagaaaaggaaaaaaagtatacttgggtagcttgccatgtgctaaggaccagcggtcttccccacccttgccgctgcatcatcagtgcccgtcaccacagcaaaaaaggcaaattacatctttatgttattgcaaaaatacttctgacctcttgggccctcagaaggaagttgtaggcgaggacctccaaccacattttgacagctgctgcgataagatgtaagggtgtgatttcttgacatcaaagcaccaagcttgaatgggtttaaagcagttctcaacttgctctgcctgggtcccattgcgggaggctgtcacgcaaagtggtctggggtgtggcctgatcatggggaattctatagaccccccccacctcctcctcctgtgcagccaggtttgaaaacttctggtttagaggcaggttctaaaacattcttggtagggagggggctctccagtcctgtacaattggataagtcactgttcatgacagccaggaaaatttacaagacaaatgcctgattgaaaattggcgataataaattgaactaggtataatcttgagttgaacggaagctatgtgaaacaatatggtgaggtataattcggtttcttaattgtatacatttatgtagaggtccacttactccttcacatcactttctggggcctgcagggacaaagacaaaacatctatgatcttactagtaaaagaaagtcataaaagcaggatctgaatcctatatctacatggagctgaccatgagcaaacttaaacatgtatctttgctaccttctgtccagctccctacatgctctagagagaaagaccctgataaattaggcttctccattttaagttgtttgattacagttgagagcagatcttttctgtggagacctaaatacatgtacacagtcagtcaaacaagttcctaatttaaaacatcctcagtgtacgaaatatttaaaaggttcaagaagggattctctgtaagacggcttttagaatgtagccttgatggataggaactgtgttgggaatcatccctttcttcttctccacccccaaactcaagctttcccattggcctgtttgtggcacaacctgctcctccaatccgctgggaggtgttgatagagtcccaaactgtctctggtatcttgccaatggtaggacattctgaattggcctaaagagagaaatctctgtcttggccgtgagacaggctttcatggccatgagacattgccttggagggtcagagaaatggcatttcctccaaatctgactctcattgtaggattaacagttttcctcggtgacttgggggaattctgaggcacaggcagaggtgtggaagaaggaggaagctgcagagagcaggaatcagggcagggagaggcagaaacccctgcaggtggaagtgggatcctcctaactttagcatgccactgtgcgttacatgccagccttttcaggcccaattaagtttctctgggggtgtgaagggggatcccaaattgcataccactgtgccaggagcacccccattctcctcctgcagtggaccctgtgctctacctgctctgcaggctcttctcttaaccttacttgtgcctcgaagctcttgttgtgtgtctcctctctttccttgacttggaagtcctttcttatcctttatacatccagaatgttctcttgcttaaaggtgtcttctgggaaaccttttccagtcctttacattctcctttgcactgttaatcacctgagctcctccaggccagggttttgcattcttctcagccaacactttgggagttgctgcacacaatggatgggctttgacactctgggcttttcagtagccccagggcagcctgtttcaaatcaagacctgctcaccttgaaggcctgtgtttgctcagcctcatgtttgtattttcccgtcatcttcctgcttgatttctttgatctggttgtgctcagtggcgcccccgtctcccctgaatctttttttttttttttttttgtctgtctgagacagtctcactcactctgttgcccaggctggagtacagtggcatgatctcggctcactgccacctctgcctctcaggttcaagtgattcttctgcctcagcctccccagtagctgggattacaggtgcctgccaccatgcccggctaatttttgtatttttagtagagacggggtttcaccatgttggccaggctggtttcgaactcctggcctccagtgatcctcccgcctcggcctctcaaagtgctgggattacaggcatgagccaccaagcctgcccaccccacccttttcactctttcactctttccagattccatacgcatagcctgccatctgtcccacattgacgctgcactcccctttgaaccaagcccgctcctatctttaaaagccaacttcaggttcactttgctatgaaaagagttcacaccaagaaaaaaaaaaggagctgacattccttcacaaccaaattacgttaaaaagataagacaaaaatctcttcctgggagaaaggagaaataggctctaccacattccgtgtcttgtgctacaggagcgacactagtgagccaacatcaggggaacctgtactttgaaggttgagatgaatcctctcccctcagtgaggagcatcccagtgccatgaaatcagtcatcatcgaatgacacagccttttaaaaaaatgcattaactcccccgacccccaaaaggagagcccgggtgcagcgactcacacctgtaattccagcactttgggaggctgaggtgggaggatcactggagaccagaatttgagaccagcctgggcaacatagcctgaccctgtctctacaaaaaaaaaaaaaaaattgccgtgtatggtggcgtgcccctgtagtcccagatacttgggaggcagagacaggaggatcacttgagcctagcagttggaggctgccgtgagccatgatcacaccactgcacttcagcctgggcggagcaagacctgtttcttaaaaaaaaaaaaaaaaatggggaaaacaacttacgcttttgctataccctcgtagcgctcaacacaaagtattagttggtgatggatagttttcagacttactggtgaataattttgcctgactggtatgtaactcttaaaactcagaagctaagtaggacaaacaccatgcaagatatggggttacaaagagaaaatctggagtatataaattaatcgtttacatgacctcatgtgaatcacaagtagtttactgtttgtaaatggtaaatttggttttgtgacctttttttacttcatgctggaaactgtgatgtttggttttttcatggaggtgagtgtggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactggatgtgcagaaggtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgttgcttttctgagtggttggatccagtccttctgatcttttgttcttattgcacaaattaggagtatataccaatggtaacacttaaaacatctggccaggtgcggtggctcacgcctgtaatcccagcactttgggaggccgaggcaggcagatatttgaggtcaggagttcgagaccagcctggccaacatggtgaaaccccgtctctactaaaaatagaaaaattagccaggcacggtggtgcgcacctgtaatctcagctactcgggaggctgaggcaggagaatcacttgaacccaagaagtggaggttgcagtcagccaagatcacaccactacactccagcctgggcaacagagtgagtgagactcggtctcaaacaaaaacaaaaacatctaacttcatatttccatttgcatcataacagcagatctgaaatgggaaaggtcctcttgtccccgttttagagcgtgtgaaggaggcatggcttgcttcttcagtgccccactgctcaagcctctaggggagcatacagatgggcaggccgtggggctccgaccccatggcagtgtctaggggtgaatgtttacagctgaagccccagtgggtgtgtgttacagggtgccttttagtttagctgtctgtaggtggcttgcgttagtcggctcaattagatcctctgccttattgcaaggatagagggctttctgtatcccctggttcttgccttggtgtaccaaaagaatgagatcacatgtgggcttggagaatgagtgtaaggttttactgagtggaagtagctctcagcagataggggagtcagaaaggagatggttttcccctggagtcaggctgtcgagcggcccgactcttctcctacttccccaaccaaacgcagcgttgttctgctggtcaaatggcctaggcccatcaatgacctgccagtgcctatcagtctgctctcgacgttgagctgcttgccttcttccaccaatctactcgtctcaatgcccagccgcttgtgtgtctgctcgctagggtttcaggggttttgtagacacaggatggaggcatggtggtccagggtggtcttgggaaatgcaacatttaggtgggaaggcagaagtgcctgtcttcagctagtccatgggcacaggcttctgcagtggagccttcgcaagggaccacgcccacctctacccagcacttccctgcccacttctgtatcagatctacaggttgataattctgtaatggactgtaagggactactggttaagaaagccagcacattctcttggaaagagtgctgctagctttctgttattattcattataacaacacagcacattctcttgaaaacaatgctgctagctttctgttattattcattaagcaattttggccaattatcattctagaaaaatagagagtgagatctagcttaagaattttcagcagactcattaaaatgtttcccttcaatatacttctgtggttgctgtacttagttgtattggccatgcagttttaaaagtccgtgttacagtgcacacaagccatggagactggcaggagtaattcatactcagatcaagggacttgataaacattggtgcattcagctcaggttcatggagccaactgtgtttttttgtttgtttgttttttatttttgagcggagtctcgctctgtcacccaggctgcagtgcaatggtgcgatctcggctcactgcaacctccgcctcctgggttcaagcgattctcctgcctcagccttctgagtagctgggactacaggcacgggccagatacacgcccggctagtttttctgttttttgagatggggttttgccatgttggccaggttggtcccaaactcctgacctcaagtgatccacccgccgcagcctcccaaagtgttgggattacacgcgtgagccaccgtgtacggccaaactgtcacttcttactgtgacttttttttttcctgtggctcagagtgggaatggatatggttgggggagcttattaattgtatgtggaaaaccactttttgaaaactttatgtatatataaatatatacatattttaaattttgtatgataaatttgtgtgttttgtggcgtatcagttggaaatattacttttaggtttatcatcaattaatagggacacttaggctggcctgccatctttgctgacaccccagtgttgaagcaaatattgctggcttctctctggggagtttgctgtagcatgggctggacagatggtaggtatactctgcttatgcttatcctctgtcagtctgggcaaggaatcggatattccttctgaagctgcttattctatgatcactcagcagttgaacaagcatcaaaagggaatctggattgctttcctggtctctggatggcagatattaacaatgtaatttattagctgggcgtggtggcgggagcctataatctcagctactccagaggctgaggcaggagaatcacttgaacctgggaggcggaggttgcagtgagccgagatcaggagatcacgccactgcactccagcctgggaaacaatgtgagactgtctctcaaacaaacaaacaatgtaacttagttgtttggagggaattcatagaaaaggagatctgccagtgattttcatgaagttccttcctttactacggcctccttgtgcaagcttaaagtgacttcttgcctggagtatttaaagcacctagtctattcccccatctccttattctcttaggtctgttttttgtgctttgaccagattcccaaatatatttctgctactcccttgctctgaaaaccttcattggttccctagaggagaacttgttggcctggcattcacattcagggtcttcagcaattaactccagcataaccttccattctcatttgcagttgtcacttgtgaactctgcagtccagccaggctcatctggtcactgtggctggagcgcgtcttgtcctttctctcctttgggcctctgttgacctccctcatgactctattggtattattctcctttttttgagtgtttacccactgtctctaaatcacctccactctggctcatcactcaccgtggccttttctgacacctctctatatagaaccatttggtgacattatctatactgtcactgcggcacttggattattgctttgtagatttcccagtttgcacctaatttccccaaatagatggcaaattcttaagaaaaaatgtaatgtttaaagtatgtttttgtgcctttgacaacatttaaagaaagctttgaacatagttgttatatgataactagtgaatgaatcaaatctaaatataaaaatacaacttaaggtcaagaataaatgatttttgtaacacctgctcctctggattacccagaagtcttctgaagaatattaaattttgactctgcaatgttttgtatctaactgaatgcctgacaaatagtaggtgcttaataaatatttgtcaactggaataagcatttgaatagatgaattaagttactgtggttagaataaatgaagaaagtctggatgtaagccatgaaactcacaaccatttggcagcgatacacacacagtacatacagcttgggatctaagctctgagtgatttaggtagaagcctagcttttcaatacaatggaattctttttttttttttttccttttgagacagagtcttgcccctttgcccaggctggagtgcagtggtgcgatctcggctcactgcaccctctgcctcccaggctaaagtgattctccttcctcagcctcccttagtggctgggactacaggcatgcaccaccatgcccagccaatttttatatgttttgtagaggggttttgtttgcccaggttggtctcgaactcctgggctcaagtgaaccttgtacctcggcctcccaaagtgctgggattatagccaggagccactgtgcctgacctcatttgttgtatacttttatttaatagtcaggactgtcacagcgatgcagtcaggggcatgaaggtatctcatatttttaggaatagcgtgtggagcagttgttaatagtcaggactgtcacagcgatgcagtcaggggcatgaaggtatctcatatttttaggaatagcgtgtggagcagttgctttgaattttgagagtacagccgtgtgtctcaacagttttagcacatcagaatctcctgggctggatgcagtggctcacacctataatcccagcactttgggagggtaaggcaggaggatatcttgagcccaggagtttgagaccagcctaggcaacatggtgagaccccatctgtattaaaaaaaaaaaaaaagaatttctggagagcttagtaaaattcagattgctgggcgccattctcggggtgtatgattttgtcagtctgtggtggggcccaagaatttgcatttctttacgttcccaggtaatgctgatgctactgattcagggaccacactgtgcgaaccattggattagacacatgtagcttgacagatattaatttcaacctttccatgtactagcagtgttcatataaatgccaggagttatgaagctgtttttaacactgactgagaattttaattgggaattttaacatatagaattcggtggtttatacacatagtactttgtcaaatctaacttttttaaagtggttaaacattttaacagcgtaaaggcagacatctgctcttccaaagttcaaatggttttattatttaaatattggtatggaacaacttttccaatacatatctcctatttattcttaaagcttggtataacttgaaagaggaaataaaatacgggtaagtggaaaagtgatggtgttgttaactaattacagtcagctgtaacaaaacaaattattgctttgacctgacgtagcattttagttgaggtttactatgcagtttattgaagccattctcttgttaccttcagagttattactgccattattttgttgcttgataaactgaggcctgataaaaggttcagattaaggtcatgctgcagaaattcaagaacttgtgctgtgccctgattctggaatgctggaatccttgggtttctatttattcgtctgctactgtattttgttttcttttttaagaagcttgcttttgaaaggcaggccttaagtgggaggtattcagtgtttttaatgcagggacaggcctaagtgtctaaaatgccttcctaaatgtctgtgagattgtataggaatgaaccattaatgtttatgactgcatggtaggataggtcatttattctttttctgacttagatgctcatataatttattaaatttgagaagctcataaggcttttgtaatcagataaacaatagagacatgaccttgaaaacaaaagaatgatatagaaaaccaccacttaacgccaccaaacgtgttttttttttttttttttttttgagccggagtcttgctctgtcacccaggctggagtgcagtggcgtgatcttggctcaggccgactgagctgagatctcaggccgcccgcctcagcctcccaaagtgctgggattacaggcgtgagccaccgcacccggcccaaactgatgtttaaaataagagaaaggcccagtggggaagttgaggaggagcgaatggacatgtgccctctccagacttgggggtgtggaataatggcattggaatgtctcatctcattagctgggaagaggagagaagaaaggaaaggaatagaataaaacagtggtttgggagtgcatttacaggagcctagcataggtggatttggtttcctttcagagaaaagtgacaccaatgctgactttaaaatgaggcttcaaaaataaattttgttgtagatctcagccagaccttccagagcttgcactttagttttgccctctcccttgcatgtttttgttttcccacacactcagccagtggatggtttctgggcaccttctttgggccatgcattgtgctggaaatttctctcatgagccaattctgtctgcttaaggacacttaaacctctatttatttctttatttttatttttttatttgagacagagtctcattctgtcacccaggctggagtgcagtgacgcgatctctgctcactgcaacctcggcctcccaggttcaagcaattctcctgcctcatcctctgcagtagctgggtctacaggtacgcaccaccatgccgatgtccggctaatttttttttgtattttttttttagtggagacggggtttcaccatgttggtcaggctggtctcgaactcctgacctcaaatgatcagacctacctcagcctcccaaagtactgggattacaggcgtgagccaccgcgctcagccttaaacctttttagaaaagtgaaacaaggccaggtgtagtggctcatgcctgtaatcgtagcactttgggaggacaaggtggtttgattgctggagctcaggagtttgagaccagcctgggcaacatagtgagaccccatctctatacaaaaaaattaaaaaaaaaaaaagctaagagcttattaaaattcagattgcttgagctcaggagttcgagatcagcctggccaacatggtgaaaccccgtctctacttaaaaaaaatacaaaaatcagccaggcatggtggcttgcgcctgtattcccaattacttgggctgctgaggtgggaggatcgcttgagcccagaaggaggaagttgcagtgagccgagatcgtaccactgcactccagcctgggcgacagagtgagaccctgtctcaaataagtaaataaacaaaataaaagtgaaacgacaagatcttatgactccctggaggttttacttttttttttttttctcccagacggagtcttgctctgtcgcccaggctggagtgcagtggcccaatatcgtctcactccaacctctgtctcccaggttcaagcgattctcctgcctcagcctcccaagtagctgggactgcaagcatacgccaccacgcctggctaatttttttttttttttggtatttttagtagagacagggtttcaccgtgttagccaggatagtcttgatctcctgacctcgtgaatcacctgcctcggcctcccaaagtgctgggattacaggcgtgggccaccgtgcctggctggagcttttacttttaactcacattatttttgatgccaagctacttgaaaaatgattattcctcagtcccttcagcaaatattgacccactgtgtctggcagtgtgctaagcacggaggacacagtggtgtgcccggaggctgggtgccttcttgctggatctcacgtcctggtagtcctggtaggagagaggccattcactggagtcatctctttggatttcttgttgcttgttgctccttgctctcttgcaggcctgcatctgctcctttcatcatggttaaaaccgcaaggccctgaagacctagttgtctgttggtcttttctagaactgtttgcttgatgtcccagcagcagttgacaccacagcctgcttgctctgtgattcaagtcagctttaacctctgtgacgttgtattctctgtttttcacgctccaggtcttggctctcctttattctgtaacagctcctcccttccttgcccagatggagctagcacctccagtggtgactcttggatctggcttccagtctcagcctctcccaaaagcacgcgtttcatgttcctcaccctcacccagccctccacctgcacacctgcccaccctctgctctacacacccaggctcctgctctctgcctcccctgcatcttaattcctggcagcccctcagccctccagttctgttgcgtttcatcccccacatgtccctggaacaggctcctctcttacatttgcaggccttagagttctggtctgtccttgaactcactttggtggttccctagcaggtctttctgcctctgatctctctctccttcacttgccctaagcagttgcccttagataaatctcctccaagcacagctctgaccgtgtaacctccttgctcagaactcagtggttcccattacatcccagagtcaggagagctggactgaggcccgcctcaccttaccctagcccatctttcatactacatgtctccttcccttttctcatccagttcctcagcctcacttccctgcccatcattccaaactctacccccactttcctgcttccactcctttgtccttgctgctcctttctccttcctctccttttctcatttttcacctgtgtcctgcatctttttttaagtgcaactcaggtgcagttttgtccatgaatttctaactaggctacaagccatctctgtttcctctgacttcccatggaagtttatgggtcttcctgtatgatggtaggtggtaggtggtattcccttcccatcttctatcctagaccgtagactccctgtgggcacggcagctggcagacgtttcaggcacccggactggctcttagaacattgtttaataaatgtccattggatggatgacttaggaattcatttattggaattgacaataaacactttaatgtctgtgccagaggttgggaaactagtctttgggttagatcagcccactgcctgtttttataaataaagttttattgcaacacaagcatgctgcagcagtgattgaatagttgacaaaacctgaaatagttactgacctcttacactagaagtttgcccctggtccgcacctttggccagatttctgaagatacgtgatcacctgtggaaggaagttaaggaaacaggtgttcacctaaattcacctaaactcttggccactcgttttgactttctaacctatctatgtggctacaattaattttgttttaagaatgcacaatcaggtcaactagatttgctcttcagtttcttgacattaggataggaatttctggatagaagttgtgctgttgggctttatgtaattaaaatcacctctaaaatggttttgatactctcagtaaaaacaatcagctgagtctttcggttgtgccaccagagtgaagcgaaccttagaaactctcccttattttggctataggagaagcaacagatggttttgtcttctgcatattcagctaccttgctccgcaggtcttgggtaggaaggtttagaagtaaagtttcgtggactaacattaataccatgttgtatttttcttttttcttccaatttagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcaggtatgatattaattacccagagagtgaactggttgtgtgaaagccacatgcatgtgcacacacatgcacatacacacagaggcacacacgcacttgtgcgcccagaggcacacacaggtgacacacacaggtacacacacatatgtgtgtgtgccattttgcacacatgtaggcacaatatgcaaaatgtgtaaggaattttttactctgtcaataatgccctttagcctcaaaggttggctgcaaggaattggaaagaaataatgtacaaacttgttttctttttcaaattttacttttctcattttttgaatgttgcataaataaccagttgggcacaggcagatcacaagtactgaatgaggtaccacctcctccagctttgtccccactttcgttgggcaccttagaaaatgctgggtaaagccttctgggtggcagtaatctgcgtgatgaatttgcaccttgggaaggaaacaggtcataatctgtatggaagaaaggtaagaaaaggaattcggtcactgttgagctggacccaacctgggtgcatttttcgctaggaatagaggtcagtctttcattctccaagtttgtttttttttttgtttgtttgtttgttttggtttggtttttgagacagagtctcgctctgttgcccaggctggagtgcagtggtaggatctcagctcactgcaacttctgcctcctgggttcaagtgcttcttttcacctcagcctgtgaagtagctgggattacaggcgcctaccaccccacccggctaatttttgtatttttagtagagatggggtttcaccatgttgaccaggctggtcttgaactcctgacctcaggtgatccgcccgcctcggcctcccaaagtgctgggataacaggcatgagccaccgtgtccggccccaagtatgtatttttaaaatagcatgcaatcaagggcatttgatatttggagtaaaacaaagcattttactttattagagaagggagcgtttatctagggctgttctgcttcctcagttgcaaccattttcatcatgcccgtttgttagcagcagattgaaggcatcaaaagcattcagaggctagattaccttgtacagaggtatgttgtgggaatatgtaggtgaaaagttagactcaacacctccaagccctcttccaagtgaaagacattaggattctgcaagaactgttctcattctggatgcatttgccatgctcaggcttcctcagtggggatttgattcaacgcaatgccacatatatatttgggagttcagtgcaagtgtttgaccctctttttcactttcccagctttattgacgtatcatgggtaaaaaaagttgtatatatttaagatgtacaatgtgatgatttgatatatgtgtaccttgcacaatgattgccacaattaagctaattaacaaacacattaatcacctcacatagttaccatttttatgtgtgtggttgataacacttaagatctactctattagcatttttcaggtgtacagtatattattaagtacagtcaccatgctgtatgttagattcccagaatttactcatcttataactgaaacttttttttttttttttttttttgagagggagtcttgctctgtcacccagctggagtacagtggcgcgatctcggctcactgcaacctctgcctcccgggttcaagccattctcctgcctcagcctcccgagtagctgggactacaggcacgcgccaccaagcccagctaatttttgtatttttagtagagacggggtttcaccatggtggccacgatggtctgtatctcttgcccttgtgattggcccacctcagcctcccaaagtgctgggattacaggcatgagccaccactcccagccgtaattgaaactttttaccctttgcccaacatctttttttttttccagctcaatgaattttatttcccttgttgtatataaatgctttgattgaccagtagatatttgtcaaccattagtatcttggttctgttgaaggagtaagaacattttaaactgagattttttttttcttgtcttttcttttttttttttttttttcctgagacagagtctcactctgtcgcccaggctggtgcgatcttggctcactgcaacctccacctcctgggttcaagtgattctcctgcctcagcctcctgagtagctgggattataggcacgcaccaccactcctcgctaatccaacatccctttatttcctccacctcgagctcccggcaaccactgttctctgattctgtgaggttgactttttaagcattatttaggccaggtgcggtggctcatgcctgtattcctagcactttgggaggccgaggcgggtggatcacgaggtcaggagttcaagacctgcgtggccatcatggtgaaaccctgtctctactaaaaatacaaaaattaactgggcatggtggcgcacgcctgtaattccagctactcagaaggctgaggcagaagaatcgtctgaacccgggaggtggaggttgcagtgagcagagatcgcgccattgtactccagcctgggcgacagagtgagactctgtctcaaaagaaaaaaagaattgacttttctaagcccacttcaagaaaatgtgaattgaaattttcctctgacccattctgttccattttgcgtctgcctttttcaggtattaaaatgttgttaaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattatttttgagacagattctcgctctgtcgcccaggctggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagccaggatggtctcaatctcctgacctcgtgatccaccagcctcgggctcccaaagtgctgggattacaggcgtgagggaatcatactatttttgaagggagcttttaaagcacattgatattggaattgagaggtaatatacgtataaaggaaatgcaatgatctgtggaactgagactgagatgggagcccgggagttggaggctgcagtgagctatgattacactactggactccagcctgggtaacagagcaagacactgtctccaaaaaaaaaaaacaaaattaagtagattttgcattctactatcttctccctattatgtcgttgttggttttttccaatttaagaatgttttaaaatcatgtttgttcatgataactgtctcctgagagccaccgcgcccggcctaaaaaatctattgagttcttgactgtttgttcatatgtattttcgttagctacctcagatcccctttgtagcaagatagggtataaaaatacatatgttaactattatcaaaagactgacatgcgaatatggaccaagtatgaatgtgtatggattgatttctgtatctttggggaagaatttgatgcccttaggaaatagaaaacataaagcataggtaaaaatgataatggtgcaaaatgcgttaagacatagatgttataaagaagtattaaaattaaatagtaaaaatctacaaataatacctttagctaatgttgaagggagagaaactggatggctcactttttaaccagagtcgtttttcttttttcttttgttattgttgtttttctttttttgagacagggcctcactctgtcattcaggctggcgtgcagtggcgtgatcttggctcactgcaacctccacctcccaggttcaagtgattcctgtgcctcagcctcccaagtagctgggattacaggcatgtgccaccacgcccggctaatttttgtatttttagtggacatggggtttcaccatgttgtccaggctgttctcaaactcctggcctcaagtgatccgcccactcggcctcccaaagtgctgggattacaggcatgagtcaccgtgcctggcccagagaggtagcagaagtgtcaggaacagagatctggatggcagtcttttcctcacttcgctttttctgctgttcctggaaggctctctcactctgctctttggacaatgccttgcccctcttggtggcagcttcctaggagagggcagagtcgggggctcttctttggttgctgccctgcttttctgtcttctttgtagaaggtgccccaccgctgcacttggagagcacctgtgctgttctctcctgactgattttcttggtgtgaaaatggctcaaccttgaggccagaatgtgaggttgggtcttcaactactttcttgactgtgttgctaaggccggactctcctcctaacttaaccagatggagtcatctttttattagctatcctgcctagtaggatgtaaactctctttttctttttagattgtgatacaaatttgggtagtgtggacattttagccatattaattcttacagcccatgaacatggaatatcttttcatttatctgtcttcggtttctctcatcagtgttttatagttttcagtaaagaaatctttcacctctttgattacatgtatttttttaactattgtaaatgggattgttttcttgatttctttttcagatggttcactagtcatgtatagaaatgctaactaatttttgtatgttgatttttgtatcctgtaggataactcctttctgatttatatcagaatcaagaaagattcaaatctttcttcaaaaaaaatcaatattttaaaaaagaaacaagaaaacaatttgtattaaaaccaacaactcctttttgattcctagaaaaaaaaaactgactctagtggagatcgtcataactttttaaagctagaaggaattcttagagatgagtagaaagggtttcgaatttttattgtacagttgagacttcctgcaagcctccctataaaaacaagcaagccacgaataattactgagcacctactaagtgccaaacctccttaaaaaatagagcagtctcctagctcggcattccagaatcttaaggctcttttgtgtaaatgccctgcctgctgagagctgcttttaattgcttctggtctgcctcagcctgtgtaggagatttgtggcccaatcatagattcctgtcctgttgtgaaacaggaataacatttgtgacactggaacaaactcacaatgaatggctggttccgctgaccagcagctcaatttcacttctgcatttaattgcctgcaaaagctgtttattgccttgtgcactcctccaccgcaacattatctcttaaataaacatgttgtaccaggttgacaagggagaggtgcgtatcgagtgagcagaaataaatatgggaggactctgagctatgcctcggatctcctttcaggccctatggcaggcgccctcttgactgcttttccaaagcttgtgcccccagatgtgtagacttacattccagccacgtttagggtgtggccaaatggcagcactggcagttatttcgttctttctggtggttatgtggtctcctctgaagtgttttatggttgtccattgacgataaggcacctcgcaggaatgcattcatgtcttaacatgcttccagagcccaccatgtgctggggatctaccactgaacaaaacacaaaaattgggaaaagtgagtcttgggagaaggctgctatttcttgatccctgtagttggggattgcctaaacctttctacaggtaggaaggaaaccgcgttctggcatctgaggcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttccaaagtatctgctgtgtgggggtggccagagcactctctgcagctgtgccatatttgtgctgtaggaaggcgcagtgagggtggagccatgggaagacaaggcggaaacctggctctcaggagacagttatgatgaacaaatatgattttaaaatactcttaaattgaaaaaaaaacaacaaagacataatagggagaagacagcagaatgcaaaatctacttaatttttttttttttttggagacagcgtcttgctctgttacccagactggagtgcagtagtgcgatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcaggttttatttttaattattattattttttaattgagaaggatcttgctctctcacccaggccagagtgcagcagcataatctcagttcactgtagcctccacctcctggacttaagcgatcctcctacctcagccccctcagtagctgaggctacaggcatgtaccaccacacccagctaatttctgtactttttgtagagatggggtttcaccatgttgcctgggctggtctcagactcctggacattcaagtgatctgcctgccctggcctcccacagtgctgggattgcaggcatgagccaccacgcctgaccaattttttgtgtgtttgttttttattgtgagacagagcctcactctgttgcccaggctagagtgcagtggcgcgatctcggctcactgcaacctctgcctcccgggttcaagcgattctcctgcctcagccttccaagtagctgggattacaggcccctgccaccatgcctggctaatttttgtatttttagtagaaacggggtttcaccatgttggccaggctggtcttgagctcctgacctcaggtgatccgcctgccttggcctcccaaagtgctgggattataggcgggagccaccgcgcccggctgcctgaccaatttttaagacatagtaggagacttcacatgagtttttttttttgccactgagctccacggtcaggtttcccaggatgatgtgctctggtcactggaaactcctgggaagttctggatggagaaagcgggagtgacttgccttacgaacctgccctgggccctctcacccttggccgggagcccttcacagtcttgttatccacaagataacaccctcactccaaggctgccctctcacccccatggcccacaccatcagcaagtgaaactagccctttttttttttttttttttgagacagagtctcgctctgttgcccaggctagagtgcagtgatgcgatctcagcccactgcaacctcctccctagttcaagcggttctcctgcctcagcgtcctgagtagctgggattacaggcgtgcaccaccacgcccagctaatttttgtatttttagtcgagatggggttttgccatgttggccaggctggtctcaaactcctgacctcaggtgatccgcccccctcagcctcccaaagtgctgggattacaggcgtgagccaccgcgccagccacttttcaactttttaaaacataaagtgatgtattagatggtgggatgttttttgttaatgctcttattcagcaatgtaaaaagttgatacccgttgtctctcgcctccttcctacaccccctcctcctccaccttttttttttaagactgctgcagtactcagtgtgtccttgtgacaacagtgaagttctttaggggcttcagtgtgctccctttagcaattatgtggacttacatttgtgcttacctcttgacttgcagggtgcttcccctcccaccacattttttttttttttagatggagtcttgctgtcttgcccaggctggagtacaccaatgcagtttctcggctcactgcaacctctgcctcccaggttcaagcgattctcctgcctcagcctcctgagtagctgggactacaggcacacgccaccatacccagctaatttttatatttttagtagagacagggtttcgccgtgttggccaggttggtctcgaactcctcacctcgagtgatccgcccacctcagcttcccaaagtgctgggattacaggtgtgagccaccatgcccagctttcccctcctttttatgacagccatgggaacaccctcatgctggtctagcattttgaggaattcattcacaggaaccccaagtaggttctgctgtcaggcacatggtgaggatgtaatgattgggcctactaggtcagtaggcaagttttggagactcttctgtttaaggaaatgcaactccaaagtcatgatagaccctagaaagtttaaagccagtggaattaaagctgtcatgttccctgagtttgggggtcacattactattagtataaactttgccttaaatggcttgtcaagtcttagccatgcctatgatgttttcttctgcaacataattcctcattaggttcctctcttttaaagagaaatagtggacccaattctcttgggtctttacaacatagtcttactcctgcagggagcaaagctttctttctctagctggccctgtaaggagcagtgagagtccttgcccacccccacccacattactcctctgaagcattaagcctgggtgaatgcagtcccggctttctgtttctaggtgatcacctcacctaccagcactttcaccaaggagttcctattttgtctcattttagctgatgacaagtgatgatcgtgacagtcatcatctggtttttattacacctttccttgaaggaattgctattttgtttcacagatgatgaaagcttaatgacttgcatgcttttgatcctgcagcaagggtagttgtttgtaagaactggtgcctgcgatgacaattttcccagtggctctttgtctggagccaaagctcagggagggtgatggtgggaagtttagccgctgagcccagacagatggtgagaggttgggtttaggaatatcccgtagctacagtatagtgcacaggagagacatttttggagtgtgttttggttaaaaatatgtagattccagaagaaactagaattggcctctggatacctggggccctggagaatagacagctctgactcagagaatatctagaaggagtgcagacctgggcatcctaagggattgttttttcagtctggttgaagtggtccagtagcatcccaggaagccagatagagtgaaacattaggtttttcagcaaccttcggaagacttgtgtaagtcctgggctgtcctacagattcatttccattgttagatgacttcagtgtgatctgggctgagtaagaaatcccctgtaaagtgctgatgtactccagggactacttcacaattgaatcggaggcagaagcatattattagttttgcgaggttgttacattacctattatctgacacagtagcattaggttagtaaataatatagtcatttggggattctgtaattggcttgaaatttagataattagatcacagtttttgaaagctttcagatttgatttggtttggctggtggccaaaatcttatccatttatgtttgcccttttagcttactttttttcctgttaagtagacatgaatatgatatgaaattagttgcttttcagaacgtttaattacatgtataagtgattctcagatttcttaggagtctatatttctgtggtctcttaagtgttcctcatcatttgaataaagatgaaaatcaagggaatgcataacaggtttgccctgttttttcaataccataatagaaataggatagaaaaaaagactagagttgccaaaaaatatccactgtattacagagtatgcgttagagactcctttatgcatttgttgattgtttttattgagtggctgctccgtgcctggcactgtgctagagactctcaagtactggctcatggtggaatggatgagaaagaaaactcaaaagacccatgtggccgggtgctatggctcacgcctgtaatcccagcactttgggaggccgaggcaggtggatcacctgaggtcaggagtttgagaccaatctcagcaacatggagaaaccctgtctctactaaaaatacaaaattagctgggcgtggaggcaggtgcctataatcccagctactcgaggctgaggcaggagaatcgcttggaccagggaggcgtaggttgcggtgagccgagattgcgccactgtactccagcctgggcaacaagaacgaaactccgtctcaaaaaaaaaaaaaaaaagacacatgtaattctcttattcctgtttcgatcagagcccggggagaactgtgatgccttgtggaaagatgagcccttgctgtggcatgccaagaggcagggtggggacaagtgtttgatcacaactattgtttagaatttccagtgcatggtgatagattgactttagtggattttatttttaaaaaattatcccacagtgagtgcacccccttactgcctccccccaggatgggttgccctcagcaccccctccttggtatagcattggccctgtgggcatcaccattgagatgcacagcctcctggaaggggtgttcatacatagactgaggaacagggaaaaaggtattatccccacattttatttatcacattccttctcacaacattctttctggcaagtcccagttctaggggaaggaaggcagacataattctatgtctggagtatttgtataaaaccaaaaaatgggaaggcctggaaatttcgctgtctcctcactcccttgcccgtgtgtgtgtgtgtctgtgtgtggtgtgtgtgtgtgtgtgtgtgtgtgtgtggcactgcaggacatgtcaaactaaagtttatgtacttaaaatcacctttaaagtgtataatggaaaggtgttttgtttgagtcatttgtttgcaagccccgaagaggagtctttcattgcggtgccccgttctcccgttgacagaagcaggtggacccgtgaggggaagaggagggtgcaagcagaacagccctggaacagtgtcacgctgctgggcacttcctgtctcctattccatttcatccataaacacagcctttccgggctgtgagcctccttttgtggatgaggaaactggggctcagggagatgaagtagctagctagtactgcacggctggaaacggggaagctggatttggagtttgcctgactgcagagaggcacctctgttcccgtggtgtctctgctttccttgcagggcagtgcacatttcttggttttccttttaaagccgtgaaattctggaaaatcactaggcatgctgtctctcaagatgcttctgtgacacacacacccacacacacacacacacacactcacacactcttccaaatccatgtactttagggaacagtggtaacgtgatgcttttggtcattcttgtgtcatttcaattagttggaggtggactcccttcatggtcttagagtgggcagggctttttcctgccacccacaagttgagtgtgtccatcagaggtcaccagcctgcgtcggatcttgaataccagtttggtaaaggatgtgagtgtgtgcgtgtgcttagttagaatgtggccccagacagcctcaccttgccctcccggcaggctctcatgttctgtgctcataagacacccttcacactgctgatttatgctaaaagtatcctaatgtttctgacagctcatgtgtgacatgaatataatccatatttcttacagcagctaatccaagtggcttattttcctatactgctgatagggctatatctcttgatgtcgcagccctggagattgtgatggtgacatattgtttctgggtcactagttttgtctaaaacagtaggttggaacagagtagcaaaggttaattaagtttgtccatcaaggtgggaacagatatggatgcctctgatgtttctggttctgaaatcaaagttcctaaatgtgcggttgtgggcatcatttctcattttcagacaatcaaaaaaaaagtttatttgctccagaagtagagacaatgcgaagagttgttaaaagctaaaggcagcaaagtaggtctttatactaagcagataccttcatttaaaattagaaagtttccttggtttagtagagagaaatctcagaagcgtctgaggtgatttactttgaatcttgctgtctgtacttaattccttgggaccagaaccaagttatttgatctctctgagcagtttcttcctatatcaatgattattaaattatgaagactcatgagataacaagtctctatattatttctcaatagatgctcattttcttcctctgaaatttggttaatcttatcgtcagtaaccagtattttctcaggaaaattaacattaagaatatcatcagtacaacccccatccgtacaaacacacaccccagtcttaagaagcattgtagatgccttcagagactggacatgtgagagagtggagcgtgctgatcattattaaccaaatttaaaaaatacaacctttttaatttcctttctctccagccattttactgaaactctgtttcttagttgcttttatgtaaatggtacttgcatttatgcctggtatacatgggttcagttgggaagtccgggtctgtattttagatttgtgaactagacaaatgtaggtttccaacccaggaactggaaaatcctgcatagatttctcaagatgaagaaggcgctgagctagtcccagccagacactggtccaaaccaaccaccccactctcttttgtgaaccccctgatatgcaccaagaccctttcaggttttaggaaaaggaaacattttttaaaatttggctttttcttactatttacctccttttagaggtacttgcatccctttacctgatttatacgttggtgtctttcaaacattttagattgagacccacagtaagaaactgtattccagtatatatttacacacacatacacaaaatgacaagttttgtagaacagttcttaccccttacccaaattgtatatgcaatgaattcttatatacagttctcttttattctgttctgttctattctattgcattctgttcaattccatacagttctctaaaatatatatgtgtgtgtgtgtgtgtgtgtgttatatgtatataacacacactgactgcatactgaattatttgagggccctataaaaggtaacacttctgccttttggaaaacatggtctcaagaagtacactgttgttccgtcagtaccactgatggcatatggtgaaaacagttgaacaacacaagttaaaaaaataatttggcctttgtaaaatgtcaaaatactcacatctgaattgcttctgggctaaagataagcaaaatggaccactaataaatacaagtgtaatcctgatatcctatggggtttctatccttaatgggtattcaggattgttgtgggctgggcatggtggctcatgcctgtaatcctagctcttggaggggggcccaaggtgagaggatcacttgaggccaggaattcaagaccagcctgggcaacatagtgggaccctgtttctacaaaaaatataaaaaatttagctggtcttggtgttgtgcgcctgtagttctagctactcaggagcctgaggtgagaggatcacttgagcccacgagattgaggctgcagtgagctgcgatcacaccactgtactccaggctgggcgacagagagaccctgtctctaaaaatgttttttttaaaaaagactgatgtgaatttctcttccatgccctctccacaatttatggaaattgcgggagggcttgctttatatccttgtgttcaattttggttctgtttttccatgtgacttgtttgtttttttatggttcatcttagggctgttgtttatttttatttttggagctactgtaatacaaactttcctttggttctttttttttgaaaactccacccacactttttcttttgtttttgcatgtgtagtgggaaatttgggatttgcaacttaaaacatcttaaatgaatcacttctgaaatggttggttctctctgccctgttgtgtgagcgtcctcctctccactcctcccccgttttcccctcccacctctcctgggcgcatttggagggagagctttcgtttggaaaaaggactcttgggttcttcagcatctgaatgcccagccccagccccacgcttagcacagcagcttcacccctcccctgtccacccctcaccccacacacgttgaaggatcctcttggcctttgcgggaatcccttacaaaggctgagtcctcacaagtgcctgtctctgcctgcctcggttctttcctccctctaggagggaagtggagggcattccatagcaggaccacctaagagaaagcaaggtgagcgcaggagaggaagggagcaaaggactcatcttcagagctctggacacaaaaggaaaggaagtcgggaggggcgggttttcgctgtgggaatctgcttgggtcacacacctcagcatttggcctggtgctttggtaatctctgaaatgtgtgcataatagcaatcattttagcctatatattaaaatttttttctcagctgtgaaatatggaatgctgaaaaatgaataaggtgtgtatttcagaaggtgaacggggctttttgggtgaagccctttgcgtaggtgaagtctgtaggctcagacagttcacggtgtgtgcttaggtgagcttgggaacaggcatcccatttagatggttcgaaaagaagcatctattaaaactaaagccatcatttaatgagggtaaaagtcaaccccagccttcacacccagcaccaccagaagacacagaattctacagcctgtgaagagtcctacctttataaaaaggtttctgttcagaaaaccaaaggtttaccccaaatacagcttttgccatttaaaagactgtaagccacatatcaataccaagggagtttttttgtttctgttttttttgaaacagggtcttaatctgtcacccaggttggagtcagcagggcaaacatagcttactgcagccttgacctgctgggcttaagcgatcctcccacatcagcctcctgagtagctgggaacacaggtgtgcaccaccatgcctgcctaattttttaaattttttgtagagatggagtctcaccatgttgcccagactgttctccaacccccgggctcaaataatccttcctcctcagcctcccacgtgctgagatttacaggtgtgagccattgtgcctggctgagtcattacactatttgtttaaatatcagtttgcaattaggaatgttatcctatagaataactcttctcattaagactgttcccctttctgcaaatgagcattacttagagcctccagtgaagctgaatgaagctctagagagatacgaacttaacgctgaagatttttttgtcttgaagcatgaagaatcaagatacctaaatactgatgatgaaaacttttaataaatgtgagcacaggcatttttaatgaaaaaggcatcatctgatataagttcaaaaacaaatgaaaaaacttagaaattaaaaaaaaaaaaagactgttcccctttgttacatcaactccagttttatgcagccatgcgatgtttagtaaacaactagatgacaatttggtcttcacaaatcccttttagtcattcacctggatagactgttcactttgatgcaagaccaggcactcatctaaattgttactagataaccagtgactggtatttgggatttttttttttaaaaaaagaagtgaactcaaacatttttatggtttttttttcagatattattgttactataaaatagggtggctaacacgtataaaaggaaattatggctcgggtttactgtaatgcatattcttaacaatttaatagaacacaactccaaggtcttgggttgcctgcaaagttaatactaacaccatgagcatcctccaccagccagctcttatccatgggtcgtactctggttcagagactttggatgggtaataacgtataaaacatgcctcttgcttgccagtgaccactgctaataataatagtagtcatcattcactggaatcctgggtttttagggtttacttggtttatttatttgcttagcttgaaggaataaaaaaaaaccttgagaggaaacaaggaggcatttcacaaaggagaaaaatatatatccctttaggaaaactgagtggctcctctgatttctttgccgctcttgtccctcagcagcacttagctgttttcttctagctggaggtgagggactgagcacaggggtggtgctcagttagtttaaagggagcttctcaccttggcgctgttcaggccttgggttggttaattctgtgtcctgtgggaattgtgggacactacactgtagtgacagtcagcagcatccctgaccttgaccactagatgccagcatcaactccctgcccccttgtcacaatcaaaagcgtctccagatgttgccagatgccctgtggaggatcagactgcccctagttcagaactactggtttaaagtaaagtgagtttcaaaggcttcgttaatttcccattttgtttaagccaaaagtagcagggttgtgattttctttttaaagttagaagagagcaggaagtaatttagtttgaaattgcattctgccatgcctttttctgggttaattgcatttttttttttttttttttttttagatggagtcgcactctgtcgcccaggctggagtgcagtggtgcaatttcagctcactgcaacctctgcctcctgggttcaagcgattctcctgcctcagcctcccaagtagctgggattacaggcgcctgccaccacacccagctaattgtttgtatttagtagagacggagattcaccatgttggtcaggctggtcttgaactcctgacctcaggtgatccactcaccacagccttccaaaatgttgggactgcaggcgtgagccaccgcgcccatccatgaattgcagttttaacatcctgtttatattgctacacatgcacttagaaacacatagaactgtccttttcttcttatgagcaagttgtcacgtggatgggttgtttgtggattctttgaggtggatgtagctgaagtgactgatgacctcagtaagttcatgtagtagtctgttctcacactgctgtaaagatactacccaagactgggtaatttataaataaaaaaagaggtctaattaactcacaggtccgcatggctggggaggcgtcaggaaacttgcagtcatgtcagaaggcgaagaagaagcaggcaccttctcttcttcacaaggcagcaggagagaggagaaagagaacaggggaaactgccaaacacttttaaagcatcagatctcaagagaactccctccatatcatgagaacagattggggcaaccgcccccatgatccaatcaccaccgcctaccacgttccttctttgacacgtggagattacggtgtgagatgagatttgagtgaggacacagagccaaaccatatcagttcacattctagtaacctcaaatggagtctgaccctttgtatctttttcttcttttactggaattcttttatagctcagtgatcttggggattcattaaggatagtgaatgtttgaatataaataactaaattcctatttcctaatagttctttttatttcatgcttttggaaaacatggaaaaggaattaagggaataaataagcacacgcatggatttgaaattgtgtttattttccagtaagcgttagttaaaaaaaagaattttactgttcatcttcatctttttgtcaaataatacatacattgggattggcagcgttagccagtctatttgtcagatttagcctgttttagttaatataggggattgttgggatctcgtacttccaaggtatatggacgatatgttggtaattgtagagcactggttctcaatctcggtgtcatattagaattaactgggatctttgaaaatatccagggcccaggccacatcccagagcagttaaaccagattttcttgagtggagtccaggcatcagtactgagttcccttctcaccttactccagtgagagtgaagtttgagaaggaaccagtgccactgtttacaaataaagttttattggaacacagccatgcccattcattttacaaattgctagagactgtatggcttgcctaaaatatatatactgtttgacatttacaataaaaagtttgctgacacctgctatagactcatgatcaacatttttcaaacattttgaaaggaaggtttgtgtaaactttcatagtaaaaaaaacatccagcattttgcagagcatttaggcccaaatcctatctgttttcttgtaccctggcaaaattgaaaagcattttccttgaagaactggcttgaagatattgtcaaacctgaagtagatgtgacaaactcagcccccagagcagggaggctccattatttatattacggcttatgtcggcaccttgcttctaattcagtgttcactactcagactgtgtaattgacttaaggaagtctatggagacacaaatggcttttcaattcaaagtgtgtttgagtttttactgctgcagcagttgtagatggcaacagacccctgaaaaaaatcttttagttctggggaattttgtgtataaaaataaaaaaagaatgaaaattaaaaattgctatttacatagtttcacttttccagttcagctggaaactggatggttgtaagcaactggtaatttttttttttttttaagctggggcagtggctgacacttgtaatctcagcactttgggatgccgaggcgggcggatcacttgaggccaggaatttgagaccagcctaggcaacatggagaaaacgtctctactaaaaatacaaaaattagccggacgtggtggggcatgtctgtagagtaggctactcaggaggctgacgcaggagaatcgcttgaagccaggaagcagaggttgcagtgagccgagattgtgccattgcactccagcctgggcaacagagtgagactcggtctcaaacaattttttttaaagggtttcctttggtcttgggttctgagaggtactaagtatgagaggaaggatcacgtattctagtccctgggcaccagcaatatcagcatctccagcccagtcttaccatcaggacctgcattttaacaggaccccctggccattcatatgcgcattgagagctgctgggaatcatcaaaagatgctgcagtgctctaattgataactgggtgtgtgtagtaaacagctaccatgattgtcccttttctcttaaatggtttagtggcttcttaatgggctcttctgctgtgtggtcttatttattaggggtagccagtttttcctttttggctgttttccgagtatagcttctttaaccttctatttagtaaagatttaatgtggccaggcgcggtggctcacgcctgtaatcccagcactttgggaggccgaggcgggcagatcacgaggtcatgagatcgagaccatcctggctaacacggtaaaaccctgtctcttctaaaaatgcaaaaaattagccaggcatggtggcgggcgcctgtagtcccagctactcgggaggctgaggcaggagaatgacgtgaacctgggaggcggagcttgcaatgagccaatatcatgccactgcactccagcctgggcgacagagtgggactctgtctcaaaaaaaaaaaaaaaaaaaaaaagatttaatgtaatggtagaaagtgaaaacggagtgattggcctagaagagacaccatttcatatacttcagaaaaacaaactagaaaggataaaggggacttacccaggtaaacttcacttgagaggaaataatcacctgtaatggtatctttgcttctccagaagaagtaatccactcatgagaacatagatttgagcttgagagcagtagagatcaaaaataaattccttgagctgctcaaagcatcaggcagaaatcagggacttagctctttctaccaaacagcaccataatacccaaagtacacttaagccagtgttagttggtgaattgtccagaatgtagatgttcatagaaaatcttgaggaagcccagtgcctaattttacactaccaggctctgtcaagttagtgctattttctttttcaagtaccatttaaaatacttgattgaaaaacatgattttgaattattttggattattttgaaattactcatatttctggacagaattggtttatcttgaacattcccttagatcgaattttgtttaaaagcgagtaccatctaaatttaagttttaaaagactgtcataaataactgaagtccagctctgttgttgccgtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatataaaagctatctcatggtcctaaaggcagggtctggttgccggaaaaaaatgaatgactgctgtgctcacatgcagctgccactgcgaggggcgcttgtgcctccttactgccttccgagttttgctctgccccatgtgtccagttagcagaagccaaatcacctccagaattcagatctcagactcctgttcttgctgcagggaacagacaccgactaacaggatccagcatggcattgtgctaatgtccacagcttcccattacacatggtttgcatgttgttttacagtatttatttatttgttttttttaatatatatatattttttagacagagtctcgctctgtcgcccaggctggagtgcagtggcgcgatctcggctcagtacaagctctgcctcccgggttcacgccattctcctgcctcagcctcccaagtagctgggaccacaggtgcccgccaccacgtctggctaattttcttgtatttttaggagagatggggtttcattgtgttagccaggatgatctcgatttcctgaccttgtgatctgcccatcttggcctcccaaagtgctgggattacagacgtgagccactgcgtccagcctatagtcattttaaatactctccttatatgaacactgtaaggtaaccaagataaaattccagttttgcacatgaagaaacatgggaagaggtctgataacttgcgcccgttcaaacaaatttgttagtgttacagcagattgtgttgtcccctctccaccaccctgttctcttttgtactggttaatcgagcaccaaatgaacagaaggaatttcaggggtgctttagaggggaccttaagatagaaagggcaccatcatagttctaggcccagtacattggaagagcatattcatggctgaggccacttccaacttagataggctattcccttaatttgctttttttttttgagacagggtctttctctgttgcccaggctggagtgcagtagtgcaagcagccacggctcactacagcctcaaactcctgggttcaagtgatcttcctacctcagcctcctgagtagctgagatctcactcgtgcactatcacacccaaacaattttttgatttttatgtagaaaagaggtttcactgtgttgccctggctggtcttgaactcctgggctcaagcgatcctcccgccctggcctcccaaggtgtcgggaacataggcatgagccactgtgcccagcctgttaccttgttttaaagaactagataattattgtactagttgtgacatgcaatgttgatctcagtatatttcttcttttttcttaagcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcggtaggtgtctggtcacacagactggatttggggttgagagaggatggctatccagtattgggtcattagctgtgtctaatggcttagctgttagtaattgttggaaattttattgctgtgtgaagcttggataagtatcctttaaagaatttagttataaaatgactttgctatgcttgattcttaatatcatgttttttttcctttctggattcctagagtgacaggagtaagatgagagactctcccttggaagctaaaaatgtattttatggaggatcaatatgaaatacaggggcactttaaatgtggttcaagacctggtattttttgtgaagtgagtttctgtgcattgaaaactcctttcccaaagactttcattttaaaattgaaggcgtattcatctttttggcgaaaacaacataataaaacatttttgaatacaatagatctcagagtttatgcagtagcaatgcaaataactctgatataatggctttgaaataaaaaatgactgtttaatgaatcaaagcactttgaaatacatagtaactcgacttcaattttaacatcccccagcattttcactgtggtgagaggcaggtctttacagctgctgcgtttccagatcccgtgtttaagttctttatagttaagcatcctcttttgatgtaggaaagtgagaaacatacacaataggcagtaagtggaaatcagggcagtagagggtgtcttggaagagaaaccaatctagaagaatttactctgtgctaaataaaaggatatgttcattttctaagtaacttgactctttagagaacttagagaatgagaatcagaaccatgctttgatttccaaattcagaaccagaaagtctaaaatagctgggcaagttatgctttatttaccatattaacataaaataaaggacttctattaatatgaaatatataggtcacgggagcctatgtagtttgagctgcagagaggccgaagtacacattgttgattgcagtttcacttttattaagaatcactttccgttgggagtggacaagcacaactctgttttataagtattcatactatataatgtgtgcccataggtccttctttcatactgcttttgagtctatatatttatttggcttataagctccctaaggacaaacaacacattttctatactttcttacctgctgtgatgccttttatttatttgttggttgagtgaatgaatgaatgaatctggtattatttttaactgagtttggcctgtaagggcgtgcaagcatgaaaggtcagaatcctaactggcctgtctgcacaatttggggatgaagcagttaaaggaacatttgttaatacagaaaattaagaatgaaacccactttcaggaagaaattgcctgagcttcttacaccaggaataatggaatattttttgaagcactggcgttcttgagacaaaggtgtaaattcagagcaaggcagtaagacaaaaatataagaggcaatttattagagcagagaggagcgaatttggagaggagcggtaggcatttgaatttatggcagaaaaggaagcgactcagaaggaaagaggttacagtccaggaaagaaaaagaccagctgtactagcgctcacagggaaagaagaataggtgaataccacctacaattccttattacttttctggccatgtgtttatttgaaagagtagtgtgtgaggaggccccaggcttaacttcctggtaccctgctaacccactaacagttaagtaggaggcccaagcttcagaaacgagagctgggaagactctaaaatctcagcactatctactttggaattatcttcgagaaggagtgtacaaatacgtagaaaatcaaaatcccagctaatttttaacagaaggcttaatgccttccaaatgtgtgctattttggctttttttatattgcatgaatttttacaaagcaagtgggaaggtaaaggaagcgtgtttggaggtcagtaaggacacctcaaaggtcatctcatgggacactggatcctcagttttatcagcattgacacagtggggtgttctttgagagcatgttagcccttctgggaggtggggctgaggctagagacaggaaatgatgggtggggatgcggacatcagtatattcatttgtgagatatcggcaaaggttggctcataaccagttacatgtggcagatccgtcaagtctaagttcctttggttgattgtgttaatatgtaagttattatttattctaaatagggatttctaaagaacttgaaagacagtgttttcagtaggtttaatgtcttctttaaagtcttatttaagtataaatttgcccattaaatctatgttcttcagtttctttaaaaataaatttaagcttagcttctctgtcatctaaaaaaatgaacccaagttcagtgtcttcctctgggtttgctataaagctggcaacatgaaataaatggaatgttgggcggggggaggggggcattttacagggcaagttttccttttgtcgtgttactgctttttaatgcttttctttgtaaaaggataggagccattccttctttccttatcctgaaaaacgttaagagggtaggtcagagagatggtggagtcagatcttgcaggtctttgtaagctattggaaacaattaggcttttatttcaagtgagatggggagccatagcagggttcaagcacagggtgatttgtctgtcttgtgcttttaaatgatcaccctgatgactgttttcttatagactatagggatgcaagggtggaagctgggagaccagttagaaggtgatggcagtaattctggcaaaagaagatggtggctgagtgagggtgggagcgtggcagtgatgacgggtggtcgaattctggatatattttaaagatagaaccaacaagatttgctgttggtctttggatgggacaggaagagaggagtgaaggatgactccttaatttttgacctgaccaattggtattttgattttctacgtatttgtacactcctcgaagataattccaaagtagattggggtttccaattattgaggtaaagaagactatgggaaaaataagtttgtgtgcattacgagtttaactttgcatgtgttaagtttgagatgtccatgaaccacccaagtggattgttgattaggagttggatgtgtggagtctgagggggaggggaaatatctctactggagatgaagatttgggggttcagtgcataggtttatttgaagtcaatgtgatgagatcatttggagagatgaatgtaggtggagaatataaaggaccagggactgagcctgcgtgtctccagtgtttatggccctgtagatgaggaggactagcaaggaaaagagggaggaggagcagcctgtgaggcaggagggaaactgtgtgtgagcggtgccttagaagccaaattaaaggattttaatgagagccaaagagtgctgatatgtcaaatgagatgaggactggaatcgaccatcagctgttgcaaggtggaaatgatcagtgaccttctgagtggtcactttggtgggaggtgagaaccaaagcctgcctgcgtattcaggagtgcatgggagagaagaattggtgcagtgaatacaggcagctcttcaggagttttgctgtaagaggaatagtgggatgggacgtcaacccgtggggaagtgagttcaaggaagggccttggctccttctttaaagaagagagattttataatacgcttgtatgctgatgagggcgatcccaatagagggagaatttgtggatacagggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgaggttgataaaatattggggcttgtattttttgtctttcatttttctagtagcctattttttattgaggtagaatccacctaacattaactattaaccataattgaagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagccttttgtgtcttgcttcgcttagcttaaatgttttcatgattcagctacactgtcgtatagatcagtatttcattcgtttttgtggctcaatatcattccatagtatggatggatataccacattttgtttagccgttcatcagttgagggatattgggttgtttccaccttttgggtaatgtgaatagtgctgctttgaacatttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttatattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacccacctgtagttctgactacttgggagggtgaggcaggaagaccactagagcccaggctgcagtgagctatgatcacaccattgcactccagcctgggtgacagagcgaaaccctgagacacacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagcgatcctcccacctcggcctcccaaagtgctgggattataggtgtgagccatcttacctggccaagaaaaaagtctggggggctctagtaattcatttttattgtattttgccaaagtaccagaccacggtgggttggaaactggaaaaaaaaaagtttaaagcaggcctctcctgctccacagactgtttgaagatcacttgtctagtgcccagatggagggttggcttatataagaatgtggccacttcgtagtaacagatgcaagctgttcgggaagtggtagtgggaacagctttgaaatgatgcttccccagctggtgatgaagagacagatctccacagcagcccctgtgttttaacagatgcacctctgtctagaggtgggtggcactgcacatttgagaatagacatcgttctctgcatgttgaattcttgagtataagttgctggagtacgtggttggtcgacacctgcaaaaaggtttaggtttcagttggtgaaggtaatacacttagatatttttgtctgtttattttgtgatctcggtttaaaagttagaaatggtgccttatttcttttggttccgtctcagagtggcagcctgccgtgcaacttcagccttccttcacgtccaagctgcactcttttcaggagaaagaaacatttaaggtggtgcttacagatcatgaagtgttcatgtattactcatttaacacacagaggttgtcagcagttccgtgaagcgagttgcagagcatctacattttacccaaaggtcagatggccaccgtcagtgatgggctccatggagttgaaggcttcatgctcctctgtgatgtgtaagcagcttgcagaggcctctgtgctcccaaatacaacttttcgaatccatctggcgttggcaatgtcgtggaccagggagtctagcagtgcctgatttcactgataccataggcctctccttcaggatgaccaggactgcatgcaaaatgggtagcttgcacctcagggagtggacttgcttaatgctgcatgtcagacttggacttttaggaaaaggtcatctggctgcacctcccaagtttgcaggtgagaaaactgaggttctgctctctgttgggagcaccctgagatctacttgctcttgatccagaacgccaaaggtgccctttatgtgaggtgaggtgacattctgtgacaagcggccatgtggggtggtagagaattctgtacgtggaatctgaatgggacccatgacttagcaggttatgtggcagtaccagatgcttccctgagagcctcgatttccttacctgctgagagagggtgaggatgttggctctgtggaggccacaccagtgttgtgaggatgaaatggtgtctgatgtgcaaacaagctcaataatcacaaaatgcaggtaaaggatggcaggtgttatcatgacttgcccccattttttcctgcgagggctgtgtgggcatttcacatagctcttcttgtaggggagaacgatgcctttgaaatgttgtagagcttggctggcacgaaggagagtggggcaaagactcagagggctgcgtttgttatgtatgcgtcctgccctgagctgtatttctcagccagtaggatagaaaaacatcaacccttgtctttctctgctttaaggaaagctgaatgtgttttatgcaacatttagaaaatgctgagtttaatttaaacttgacattttagaaatgacttattatttgctaaatttcaaagaaaagagcactttgtaagtaaatctgttttcgttatgtgtccattttgttctcagctttaacttggaacagagaagtaagtggggctttcagtggcaacaaggccagtgaatggaagggcattggaactatcccaggagacgaggtcttgctcaggtccccagctctggagccagtagtaagatgatcaatctctttttttttttttttttttccacctggagtctctctctgtctcccaggctggagtgcagtggcatgatctcggctgactgcaacctctgcctcccaggttcaagcaattctcctacctcagcctcctgagaagctgggattacaggggtgcaccaccacacccagctaacttttgtatttttagtagagatggggtttctacatgtcagccaggctggtctcgaactcctgacctcaagtgatctgcccgccttggcctcccacagtgctgggattacagatgtgagccactgtgcctggcctgatcaatcccttagagcttcagttacatctggaaagtggaaaacaataataacacatgtatctatttttatatatggatcacataaggaattatgtaaaagtatggcagaatctgtcatctctcatatacttgtatgtagaccttttaccgtggcttatgtatctttctgttttggcaggtgcctggcagtgggctgtacaaatgaaaatgattactgtcattaaggagggctaagcgtatgtgtatcatgattcttgaaattagctagacatcatggtctgccgagtgaggaagatggagcatactaattttaagcagataataaacatttggaaatggcagctttaaagatgtattttttaatatattacacttatgatatgtttgccaagtaaaacacaccagtgcttttcagggaatgtgaagaacaccagcaggtccctttatgcctaaagaatggtacagaagcaagctgacatgctgttggatgaggacaagcagatttctgtctttccttcaaacttctttctctttctacatacaaagagcaccccacaaggcaaactgtgggcaagattgagagctgtcgggctcctaacgtgtcctctgtgtaaagcactgccatttgacaaggcctcctccaggctgtagtctggaaatagcaggacttcccaggggcctacctcagggaggtcacacttactcatgtaaggataaggtccattcactgcagcatgttagcaagaattaccagggtgtgtgcccacacggagggtcagcttcgtacttctccaggtgcctggcatcgtgcagtgttctcagatggctcccgggatggtttgtcatttcttaaatgagtaagaaaccaactgtggaatcttttctgttcgttcctcatctacttggagttaggtattccagtgaagcattcggtgaaataaatcagacaccaacaaacatggggtactgtccccaggccacagacatcttggatttatgccatgtagaatcttccctttggaaaacttgaattttggggacttaattatctatgtgtgactggtattttgattaagaacgcagccctgccggagggtcaggggtgcttattcaatattcacacttaacagagaggatgggtgtgcaggcagagcgccgtgacttcctctaagccttgttgctagtgtttaagaggaggagccagcctacgaactcagacccctgaattactttcctgggcgctctttcttctagtatatcctgtgtttttctcttcatttccttccttttctttttcttcccttacaaacacacgtgcagctcctccagtgtctgtaagacaatatctgaccactctgtgtataactcatttaattatctggataatgctattatccccatttgacagatgaggatattgaagcatagagacagtgcctgttaggtaggggaaaagaggggtcctgttccagtgtggcacgtggaggaactgaagctcagtgatgatgctgtttatccaaggcctcactgggctacagtctagcaccctcatgtcttaagtattttcaaggaaatggtggctgtgattggggttgagagtgcacttgggaatattctatttgcagggactaaaggcatggatgcagtttgtttggctgtaatgatgagatacctgtcttacaggtagcacatgcctgatgcagaaatgcccccatctggggttgtggttctgtagcacattactgtcatagtaaaaaaactcaaaagcaaacttaaacccttcggcatatcaggtgtggtgttctctttacattgctattcccaaagctcagtataaactttaagatacctttatgagcacagtaaagtcacttttaattttgtgattatatttgaattttccttttatttaataagagagagtcaagtggaagggttaatatttgataagggcagaaatcacaaaatttaactagtgattagctttgaaatcataagtgcaaatagaaacacaatcagctactttcaaaaatatttattctcttttttccctgtgggcatcagctgttaagtgattacatattctacttgttattttattgttaaactcctgtgactaagaggcctggcagttttcctcagataatttttgaggaagatgttatttaatcttcacctagtctgtcagcagcttatcatgagattgcttttacgactttaatttattctgtaaaagctatagattgaatacacagagcaactacacagaggttttcattttggctaaagattgcagcctagagaagacacaggtagagagagagagagagagagagagagagagaagctctggaaaccacagtttaggaatgcctaaatgctctgacatagccaggttgaacatacttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttgaatctgacctgaatccacagggccctagcgatttttttcagggatggcgtggagtacttctggagtttattttccctgcttgcctcttcagaggcacggcccaggccaagtacaacttgaataaccttcaggaaaggtgtgctgtccttctttcggccggccgctgtctttgaaaattgcctccagagttagtgagcaggaacagttaagatttacaaacaatgatgaagcttgtcatgcatctttcaccattcatcatccaggtgccgtgcctgggcggtgaagtgttcttcataaaaaccagctcagtgtgaaatacacctcgctgcaatgtttactgctttgaagctcgtcagcggccctttatagtaaatccagattgcgatgtgacattacagtatatcattgcccggcgcggtggcgtttacactaggaatgagtgcagtgcacaccagatgaggtgtccaaattgagttatgtcagaatttggctgttatatggggatagcttttgttttctgaacactgaaagttagctttatatgtatttatatttatatataggcatatacttcccatcttgcccgtatacacggggtatacaatagatgctgaggtcaggttccaaatgcgcttcctggtgtaaagaatggtgaccagattttatgtgccttccaaattgttgtccgttgaaattggcataaatggaatctttggggggaactagagtagatggttatttcagtttagaagcagctttgattttgctatgtgtgaagtgaccatatttgccatcctttcctatgaaaacttggaacactttctcccgggagtattgtggtacattggaatgtccgtttgataggagggcaaagaggagaaacccatacaactgttgccacccattgtggagcatcttgcctgtcctgttgagcacatatgcttggggaggtctctgaagtcagtggcttatttattatttcttttagtgggtatcaaaatcctagtgctgcctagtgttatcttgaaagatgctgcttccaagagattgatggtgttttagcttaaatctgcaaaataaaagagcacactgaatttattgcatgatcaggtttatttacattcacgctaaaagtgccgatattaaaaatgagctccataaaaaaataatattcagagacagcagccggctctgcagtcccatgatcatctgcttaacacacatattttaaaattctctgttaagtatagcaggattgttaggagagtcattttgtggtctttaaacacctggctttacattgaatccagggtctctcccccatgtatacttgcataaaatctgggttagggatttcctctactttaaatgcagaggtcaacatagccttcccagccatactctctgcctcttagttgcagtgtcttcttactagagatgattaactcggccaggtctgagcttcctgaggcagcgaaagaaacaatcacaggtgtatggaacttgacctctaggggcagtagaggagccagaagctttccattggctttgactcttggagaaccagagactatacccaaatcagcccagtagttttttaccagggtgggtcggcccaacatgtacaatcactttattaagatttcgagataaaatgtaggacactcagttaaatttaagtttaagatgtacaacaacaaatgtttagtataagcatgttatgaatattttattatactaaaattatttgtttctgaaatttaaattttatttatttatttatttttatttatttatttatttatttattttgtgcccaggctggagtgcagtggtgtgatcttggctcactgcaacctccgcctcccagattcaagagattcttgtgtctcaccctcctgagtagctgggactacaggtgcatgctaccaagcctggctaattttttgtatttttagtatagatggggtttcgctatgttggccaggctggtctcaaactcctgatctcaagtgatctgcctgcctcaccctcctaaagtgttaggattacaggcatgagccaccactcccggcttaaattttagcaccctgtatttgtatttgctaaatctgacaaccttgtacttcatctgtgtcttctctgaaacaccctgggatagaaggcaaaatggaaagtgaacaaaggattgcagtaccttctctaagcatgttcagtaattttaagggtggtttcagtttttttctttttttgagatgaggatctcactatgttgcccaggctggactcgagctcctaggctcaagtgttcctcctgccttagcctccagagtatcatttttatttctacaaaaacagtacaagagggcaatgctaatcatgcttggaaagctcttattttgattgatgttgtttagtaatttcttggtgaaaagtttctggattgtagtttatccttgaacatattaacatattatttctccttctgcttgggtgatacataggtccagaaaggtcaaaagaatattctttctttctttctattatataggctagacacattcatatatgtaaatgaaagctaatccactgctgctcagaatgaaaatggaaatttatacttttcatgcattttgttccgttgtccccctgtttgtgccaggcctaacagtgactcttaaagctgttctgcagggtcagttcctcaatatctctttccttaagtccccccaggatgtaaactgatggctcagtcagtaaacaagtgagaaattcattgagtgccagttagtgtctgggcctagcataatgctctgggagatgaaccatgagagaaggcgtggctgcagggatagtgaaaggtcagcggttttagggacacctcccttcccttcctgtctgcagaacagccttgcgtctgagcttctgtatgctgtggaatggagtagctgtgtgcccagccgtcttgactttattcaagacctggttgaagtcttcctcataaacctaagagggtgttttcttctcaaattagagaaaccaggattacagtcaaattcttgataaatgctccaaatacggagccttttccaggcacacttcacctttgttacttacatagctatagaggtaggatggagctagattgttctatttgtttgtttttttagagacagggtctctgctacccaggctagagtgcagtggcatgataatagctcattgtagccttgaactccttggctcaagtcatctgaattccttggctcaagtgatcctcctgcctcagcctctcaagtagataggactacaggtgtgcaccaccacacttggctattttttttattaaaaaaatttttttttttttgagacggagtttcgctctgtcgcccaggctggagtgcagtggtgcgatctcggctcactgcaagctccgcctctcgggttcatgccattctgcctcagcctcctgagtagctggggctacaggcgcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacatgagccattgtgcccagccctgtttgtctttttataactgcttcattaaaatataactcatataccataaaattcatccttttaaaatgtatgattcattggattttagtatattaacaaagctatggaaccatcactgctatctaattccaaaacatttccatcatccccaaaacaatccccatattactcccatttctgcctccctcccagcccctgccaaaatactagtttactttctgtctctatgaatttgcctgttctggactttttgtataaatgggatcatagaatatgtggtcttttgtgtccgacttctttcatttagcataatattttctgggtttatccatgttgtagcatgtttcagagcttcatttctttttgtagttaaataacgttccattatatggaggggcttggtttatttttagttcaaaaactattagaggaccaagaaaaactattaaaccacaagattaccaaagtgaaatatctattctgtctcattttattaagtctccagttctttgaattcaacatacaaatgtaatgagtagaacctcttctatgcagtgagaggaatgtggtgcatatggacattgagcagtccaggctgtgttattttcccgttttgtgctaatactatttctattagtctggttgggctgctgtaacaaaaaggcacagactaggtggcccaacaacagaaatttattttcttatagtctggaggctggaagtccaagatcaaggtgctgtcagagttgctttccggtaaggcttctctcctgggttgtagactgccatcttatgtcctcacatggcttttcctctttgtgtgtgtggagatagacacagagagagaatggaatgtgagttctggtctctcttcttcttaaaaggacactagtcttagagagtatgacctcatttaaccccagttatctccctaaaggccctgtctccaaatacagtcacattgggagctaggacttcagtagttttagcacagagactacattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagattgttgctcttcttttcctcatttaactccctagaatttcatttcatttcatttctacctctgaatttcagaaaatttctaatccatgccatctttgccttttaacaaatgctctgcataaccttaaacagtttaactctgatgtactgctaaagtgagagactttgccagttttcctggcagatacagcagaatttgggcctccacacgcagggacatgaatgagagagcagtgcgttatttcttgatgttataatgagccaatgcaatggtaacttcagagtgaactggctaacattcatgaactatctaatgtctatatagaccatccatatatgaaaaataaacttttacttttggaagcactttgacatagatcattttgttcagtcctaacaacaatcttactaagtaatgagaggtttttttccttctgacacaaactgggtgtcctacaattcaattcaattctgacactaactttctgaagttggcccagatgccacaggttaagggctcagtcccacaaaactgcccccattttaggctccagctgaaaatggggtgcccaggttatccacatttctacccagctggctacaaattaggggttcctacaatcccccttttggtccagtaaatctctataatgactcacagaactcagaaagtgctttacttactctaagcagttttttttaaataaaggatacaactcaggagcagccaaatggaagatgtgcatggggcgcggtatctccgtgctctttgagatttccaagctttcttttttttttttgagacagggttttgctctgtcacccaggctggagtgcaatggcgtgatcttggcccactgcaacctccgtctcccgggttcaaacgattctcctgcctcagcctcccgagtggctgggattacaggtgcacaccaccatgcccagcaaatttttgtatttttagtagagatggggtttcaccatgttggccaagctggtcttgaagtcctgacctcaggtgatcaatccaccctcctgggcctcccaaagtgctgggattacaggtgtgagccaccacgccccggtgagagctccaagcttttaatcaaggcttagggtctttcgggcgaccagcccccatcctgatgttatctaactgcctgccaccaagtcactttattagaataaaagaggcttctacatccttagcactcaggaaattccaagggttttaggaactctgtgccaggaacccaggacaaagaccaagtatgtttctgcgataccacaggtaggtagagcaaaaaccactgaccctattttatccataagccgatgctgaatagagagaatgggtaacaaagctaggaatggagcagggtgaccttatctctcctgaccgggtttcttcctgggacacttttcagcctcaggctgtcaaaccagcattgaacccttgtctttagcctgatgttgtagacctgcaccatccagtacagcagctaccagcacatagggttatttaaattttaattacaatggaaaatgcaattcctctgtcacaccaggcccatttcaggtgctttgtggctacaagaggctagttatatcgtattggatagtgcagaaacaatatttccatcatcataggaagttgtattcggcaactttttgggtcttttacagtgacaggaaaggacattgcagggtttaaacctgagaaaacaagtcccatatgctcacaaacaccatttaaaggtcttgacttttgtgggaacatcagcccttattctcctatcctgtcgggttgaggagctgttactgacagacttattgagtgactgctaacagaattagttgatccttggacctaacctgtgatgcacacttaagaaaaaaaaaaaaagatgatgaaagtgagtaactcagctagaacttggttgatctcagtccaagaatagtacttgcccagagtggaaaacttgtcttatggccttggagcagcatgtgagccttggagacttggcaaggatgctttcattaaaaccaaaactggggatgtagcattcatcccttatcagatagaagatgtgcacatattttctcccatttcgtgagtggcctcttcactctgttgatagtgaccagtgagtgacctttgatgcacacatatttttaatttttgatgaagcccagtttgttttgtttcttcttctgttgcctgtgcttttggtgtcatatttaagaaatcagagctggatgtgatggcatgcatctgtagtcctagctattcaggaggctgagggaggaggatcacttgagcccaggagtttgaggctgcagtgagctgtaatcacaccagcgctctccagcttgggcaaaaaaatgagaccctgtctcaaaaattaaaaaatttaaaaattttaaaaagagaagtcattgccaaatctgtgtcatattgtcttctaagcattttatagttttttagctcttaggtttaatccaggtctttgatccattttgagttaatttttgtatatggtgtaagggaagagtccagcttcattcttttgcatgtgaatatccagttttcccggcactatttgttaaacactctcctttcctccattaaatggtcttggtgccaagaggacaaagtggcaaaagaggaaagttttgacactttcgatgactgtggcccttttctgtgagcatcagagaacaccagacattgaatgttgaatcctaagcacaagcctataaaatcggcagttgttgatacaccttgatctctctggtgaatattttctcggttatcttacttttgtttgtctctcccagctgtctcaactatatctttcctacagttctgaaataaaggcatatagggtaaccagggaagggaatcctccaaaatcatttataatagaagcagtgagaatagtagtgcatttaaagactgtgggtgattttcaatttttctagttctaagtgactagtgtttttctaattgaaagtgactaatggtaatttttaaaatacccagtttttaaggatcatctgtagctgcttatatgtaagagatggtaagttccagtggaaaagcccctatatcctctagtgtcctataggaatattcctaaagaaacggactatcagagctaacagcagattggcaaacgaggggggcagatggataatgcctggctggttgcagcctgaaattgtcaatcacctcttaatgtttacaaaagtgaaaagtcaatgtgtagttgttttaatttgacacactcttaggttgagagagtgtaattgccggaggggacagttaagtggctctgctccttgtcagcctgtctgagtctgactccagtgctaagcacttttctgatgagcgatagattgggttaaatactggcgtaattgctcgcttccgcataccagtctcgcaatgccttgtactacatttctatcagcacttgcctgaggctgtgagagtttatgctgcaaagagagcccgtatgttcattttcatgaatcagtgtcgggttttgaaaagcagttgttacagcgctaaatggactgtaataaattacaccccctccagacccgttgagtaaatcagaactgtttatatccatccaagtggtcttttgagtataaatgacttttgtttacttatcaaaccaaatgtttgtctccaggaaatggaggcagatgatttgttcattttttaatcctgtgaatagcacttcactgctgtgaaaccagagaggaaattctgtgtattgttaggtagaaaagtgccacctatccccaccctcccataagtgaaatatcccaaagtcgttttcaaggctggagacactttattgtaattctgcaactctgagtagcagcctgtctctacccactacctcatatgtggcaacaatgcagagctcggaaaagcatggcttcttgtcccagtcatttctatgagaagaaagtgaattttgtaaaatacatttctctctctttggattgcttgtctccacttctttatgaaggatgtgtgttgcttgatacttatttacttgggagtcaagagagaactgttgaaatgtatgcattccttttgcaaattagacttatcagaggtctgccccttcttggtaggacatagatattgcagttttattgtagtagctctatggttatgaaatacctgcttcatatttaatactagatgaaagaactatctcctggctttcttcttggcttttttgatgggccattgtcttcttccacttaacatctcctgtgaggttattaggctatattaataatgtcttcttcaggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcaatgagaatcgcttgaacctgggaggcggaaattgcagtgagccgagatcacaccattgcactccagcctgggcaacagagcaaaacttcatctcaaaaaaaaaaaaaaaaagtcttcttcaaggaagccctgataatcctttcttattacattttttcttactgtgttaaatatacataacataaaatgtcaaaatttgccattttaacatttttaagcatacaattcagtagcgttaaatgcattcacaatcttgtataaccatcaccactatctatttgcagaatgtttttttatcattccaaacagaaactctttacctcttaagcaataacttcccattttccatttcctcctgcccctggtaatctctcttctactttccatctttatgaatttgcctatttcaaatacctcatataaatggaatgatgccatatttgtccttttgcatctggcttatttcactaagcacggtgttttcaaggttcatccatgttgtggcatgtgtcagaccctcattcctttttatggctgaataatattgcattgcctgtgtgcgccttcttttgtttatctgttcttctgttgatgggcacttgggtttccaccctttggctactgtgaaataatgctgctgtgaagtttggtgtacaagtatctgtgtgagtacctgctttcagttcttctggatatatatctagaagtagaattgctgcgttaaatggtaattttatggttaagtttttgcagaactgccaaactggtttccacagtgtcagcatgattttacattccagtcagcagtgcatgatggttcaactttttccatatccttcccaactcttgttgttttccgtttttttgataatagccttcctaatgggtgtaaagtggaatctgatcatgagtttgatttgcgtttcactgatggctaatgatgttgagcatttttttcatgtgcttcttggccatttatgtatcgtctttggagaaatgcctgttcaagtcatttgcacatttttaaattgggttgtttggttttttgtcgttgttgtaggagttctttattatgttctggatacaaatccttttaagctatgatttccaagtattttttttcccattctgtgggttgtctttttactctctttttagtatcttttgcacaaaagttttttttttattttgataaagtccaagttatctagtttttcttttgttgcctgtgcttttggtgtcatatttaagaaaccattgtcaaatccaaggttataaagatttatttttgtttttttaagagttttatagttatagttttagctcttaagatctttcattaattttaagttgatttttgtatacaatgtaaggtaaggatctaactctattctttggtatgtggatatcccgttttcccaacattgtttattgaaaagactccttttcccagtgagtggtcttagcacacttgtcaaaaatcagttgaccgtatatttgagggtttatattgcagcttttgtagtgagttttgaaatcaggaaatgtgatccctctaattttgttctttcttttcaggttatgttggctatttgatgtgccttggaattccatatgaattttacaatgggtttttctatttatgcaaaaaacagattttgagattttgatggaaattgaattgaatctgtagattgttttgggtactattgtcatcttaacaatattaagtcttccagtccatgaacacgggatgatgtctttctatttatttaggtatttaatactttctttaagcatttttaatagttttatctgtgcctgtcacctccctggttaaatttatttctgaatattatttttgatggtattgtaaatagaatttcttaatattttgttgctagggtatagaaatacaactgatttttgtgtgttgattttatatcctgcaactttgctgaatttattagctctatcagtttttttgtggattctctagtattttctataataagtttacatcctctgtgaacaaagataattgtacttctttctttccaatttgggtgctttatttctagtctatttgctctgactagaatttacagtattgtattgaacagaggtggcacaagtgggcatcgttgtttggtttctgattttggaggaaagcattattatttcaccattgaatgtgatgtttagctctgggtttttcatatacgaccgtgatcatgttgaacactaatagcctgatttgcttgttttctggactctttaatctaaggtaatcattaatctatgaagaagtgggtggtggagttgtcaactgctcagtgatcttgtaacccacccctgccttcactggttaggttgggttgccccactccatagccttctagggctaccttaaaggtaccagtaacaccccatttatgcctgtgcatccttttcccctaagaatcctcttcgtttacacgatttagtggatcctgacctagccctgctcatcttctgtctgtcctagatagttcagcttcttcctttcaagatgcttccatcccagtgcttaccctccactctagagaccacttaccaggccactaaggacctccttttaactgtctgcttattcctgttgcacttaactcccaaattgcaccatatgctgggaacaatcttaactccctacccagtcctcctaacttccctcattcaccaagtcttcttctttaattagccgtctctaaaactcttatgtcaggatatttccaaaatgaatgacaaaaacagagttaatttaccgtggccagtcttgttttgaaatatgaaacttccccacacatgctgaaaatattttgtcctgttctctgttgtatattctttctctcgtttgttctctggactttattattcctttattggcatttaatgcacacctaagctacaaagagggctttgcattattctctgcttaactcctattttagagcatcatacaaagttatttttatcatttttaccaaaagcaatacaagctcacggggggaaaagtcaaataatgtaggagtgtacaaagtaaaaccagaaattttgtagtgaagttttatagtttctttcatatagatactacatatttttcctctccctcctctgtatgttgtagaaatagtcattaatacctataagggtggacattatactggcagaaagatttgcccaatttaaaaatgggcaaatgacttgaacaggcatttctccaaagacgatacataaatggccaagaagcacatgaaaaaaatgctcaacatcattagccatcagtgaaacgcaaatcaaactcatgatcagattccactttacacccattagaaaggctattatcaaaaaaacggaaaacaacaagagttgggaaggatatggaaaaagttgaaccatcatgcactgctgactggaatgtaaaatcatgctgacactgtggaaaccagtttggcagttctgcaaaaacttaaccataaaattaccatttaatgcagcaattctacttctagatatatatccagaagaactgaaagcaggtactcacacagatacttgtacaccaaacctcacagcagcattatttcacagtagccaaagggtggaaacccaagtgcccatcaacagaagaacagataaacaaaagaaggcacacacagacatagagaccaatagactaggatagaaagcccagaaataactcccacatgtatggtcaaatgatttttgaccagagtgctaagaacattcaatagagaacattcttaacaaatgagctaggaaaactggctatccacataaaaaaaaaatgaagttggagtcttaccttataccatatacaaaaattaactcaaaatggatcaaagacctaaatgcaggacctaaaattatgaaagtcttagaagaaaacagaggaaaagcttcattacattggatttggcgatgacttcttggatatgacattaaaggctcaggtaacaaaaggaaaaaaaaattggacttgatgttgaaaatctgtacatcaaaagacactattcaacagagttaagaggcacaaccttcagaatgggagaaaatatttgcaaatcatatgtctgataaggaattaatatccaaaatacacagagatctgctaaaactcagcaacagcaaaacaacccatttcaaaaatggccaaaggacttgaacagacatttctccaaagaagatatagtaatggctaatacgcatatgaaaggatgctcaatatctaatcattagggaatgcaaataagaatgacaatgagatactgcctcacacacattaggatggctactataaaaacaatgacaaatgttgacaaggatgtggaataattgggacccttgggcactattggtgggaatgtgaagtgctatagcctttatgcaaacagtatggtgggtcttcaaaatatgaacccaaattaccacatgatccagcaattacacttcttgatatttaccccaaagaagtgaaagcagggtccagagatatttgtacactcaatgttcacagcagcataaatgggggtcaacctaagtgtccatcaacagagggtggacaaagaaaatgtggcgcatgcatgagcgtgtgcgcacacacaccccctccccccccccacacatatgcaatggaatattaaaggaaggaaaatctgactcatgttataacatggatgaaccttgaggacattatgctaagttacatgtcgttcacaagaagacaaatactgtatgattccacatgtttaaggtacttagagtagtcaaaacatagaggcaaaaagtggagtagtggttgctgggtgttgaggggaggacagaatggagagttatcgtttttttgggtatagagttacagtttgagaacataaaaagttctggagatggagggtggtgatggttacacagcagcctgaatgaacttaattgctattgaactgtacacttaaaaaatggttaggatggtaaattttatgtttacatgtatttcaccaccaaaaaaataggaagaaaagaaaaaagtatggacattttatttatatcaagtatcttttttgcatgtatcaaaatgataacattattttctctttatttatgtagtaagtcacattgatgaatgtcctaatgtggaatgattcttatattcctggaataaatcttatctggttatgaggtattgtccttttagtacattgctggattcaggttgtttgtatttatttaggacatctgcacttatatccagaagtgagcttggctttctatcccagtttgtggtatccttgtaatgttgttatatcatggttatgtataacatgaaacagaagccatcatcttcctttattctctgggacattttaagtgacataggtatgacaacatcttggtatttgaataaaattgcccatgaccatctaggccttggtctttttggagatggggggtaaatcttttgattaacttttctgtttcttttatggtaatcttttaaaaacaagctttcttcctcagttttggcaatgtgtctttctttaaagagaaatatcaattttccttttcctttttatttgagtcagggtctcaatgtgtcacccaggctggagtgaagtggtgtgatcatggctcactgcaaccccaacctcgcaggtttagttcatcctcctgcctcagcctcctgagtagctgggactacaggcgcgtgccaccacacccagctaatttttaattttttgtagcgatggggtttagccatgttgccgaagctggtcttgaactcctgagctcaagtgatctgcttgccttggcctcccaaggttttgggattacaggtgtgagccactgtgcctggcctatttttcattttaaacttgatataaaattgcaatgatgatctctcaaatttttaaaaacactatacctgtggttctggaggtacatctcaagtttattgcttttctttttgtttattttcttgtgttcatagtcagattttccagaggttcgttggttttattggtgatttcgtagcaacatcatgagtttatttgtgcatgtgtaaattttggttgatataatttatagttgtttctaaagagacttttgaacttctttatttatttctatttttttttcaatcctcacaaaaaacactggggtgttatttaagccatctgtcgcaaagaattactcccttaaggaatgtggcaaataaatcgcagagcaggaattcaaaaccagatctgactttaaacctctgcacacccctccccccaaccctatatgatgctgcttagtgaagtatacaggatatctgtgtcttagtttgggtttcacataaaagcagaaccgaagacaataaggatttgcgttttgatagcatatcaggttgttattccaaggagtaagagtgaaggatcaggaggaggaagaaaagccaacataaaattgtgaaggcaacaggtgttagattcagggctttctgcagagttcctagagagccttccagaatcattcatctgaggataaaacagagtatttaccttcccatcggcccttatctctcaatgaggtgttgaaccccctcacttctgagttgcacctgtgtacttgaaaaacagtaacaggagccctggggcaggaagtgactcatagtctcatctccatgcaggttgctgtcacagggaggtgaggtgatgctttcacagaggcattggctggagaatgagagttggcaccaggggcaacgaggacactctctcaacaggcatgtcactggaactcacacttgacagtacatttacccaaatattttctgtgcaagtaatacacagttgtctaacacttacatcctgaatttggggtgctgataattatttttatttccttaaattctgaaggtcatggggatggtggggatatgtatgtggtccatagcgaaatggacttcttcttctgctagaagcaagaggtcagggaggagtgttggaaataacgtgttaaagatccgccagcagattacaatttactgatgaaggaccccattctcaagaggatttatttttgtaagaaaagccgcaaaagcacaatgggaaagaagttatttttatctttcttaatcaaaatacattgatttaaagaaaagatgagtttaaaggtatccttcagagtatgtggttggcttttgggcttaagcactcatttgtggccaaattcttttcccttgtgtttcttggagtggggcagcattgcataatggttgagagtactgtgtttggggtctctcagacctgggtcatcacttagtaaccatataaacttgggcaccatttgacttgggcaaatttcttcccctctctaaaccttagttttcctgactgtaagttggaggtgataggatgcatttcatttagtttttgtgtggagtaagtgaaatagtgtttctaaagggcttaacactgcacccggcacatgagtggtgttcactaatttgtagttactacctttattggttgtccaggaattccatgatctccttaattattgtgtgttcctgattttgaacctgccacagttttttgaaagatttcagtggaaagattacagtcaagagtaattccaggaaacagtatgcttagtaggattagactgttgtaatttcccctccagcatcctcacacaataagcacattcaataaacacatatacaattttcagcagctcactcccctcttgctcctccctcctttgagagaaaatgatttgataaataacatggtaaaataaaactgattttgtgtcttagtcctcctgattgtttgcattttaaaaggagatggatatttaattctgaagaaacggatctttaatggtggaatttcagatattttggtccttgcttggcaggcacattttgagaacagaatccgttgccctcatttataagtagcaacctcttttgggtaaatggtaccaagcctgattcttgctttttgaagtgctttaagttgtgtttgattccaaatactatatttgtgcacccattatgatatcaaatgcttataataaaaggttatgttgtcataaaatattactattctatggtgtttcaaacataggcactatcgtgtattttagttctgttagttacttgctttggaaagcacatgaccacctacaaagttaacaagataatttggtaaatctagttgcctaaaattaatgtcccccaaacaaccgacttaatctggggaattgtccagacctctgtcagataaagcagctgtataaaaacacattgacaataattatgaaatctactacaagttttatccacaaattagatcctttgcaaaatagcattttcaaaaagtgaaaataaagtgcttcatcttaacagtatagctagctagactctaatgtttttgtctttctttctttctttcttttttttgacatggagtcttgctctgttgcccaggctggagtccaatggctcaatctcagctcactgcaacctctgcctcccaggttcaaacgattctcctgcttcagccttttgagtagctgggattacaggtgcctgccatcacgcctggctaatttttttgtatttttagtagagacagggtttcaccatggtggccaggccggtcttgaactcgtgacctcaggtgatccaccggccttagcctcccaaagtgctgggattacaggcatgagccaccgtatctggcctgtttctgtctttcataataatttccaatcagccatttcgtactttcatcaagatgaaacttgctacactgctattttttgtatttttattcatctaaaaaatacctttaaaagcagagatttaaaagacagcagtcagaaataactggaaaactggtttttcagaacatgtttctcaatgtatagttaagacagctttatttttttttcttaaatgaacagaacactgctgtttttattctctgtagttcctgatgagttgcttttttaaaaaaaaatacacactttttttttttttttgccagttgtaatcttggcgtaatacagtgttatggcctacttttccctcattttatttattttaacagttgcctcaagagctaaactcttgatgtgtgttgttccagaccttttgctatgaaattacatgcagatatgtgtttctgtagaaatgtggtttgcttggctttttaacataaggggtgttgtagtcaatgtattgttcctcagcactttccttttttcaatcaatgcttggtcttagagatcttacatgtttagtacatgtaggtctactttattattcttaactggcacctactattccacagtttggatggagcatggtttattagttaattttcttatttattggcagtcatgttatttttctttctttcttttttttttttgatgtgacaaacaaatgctgccctctccttgtgcaattgtgctggtgtttttctggggagatgaaagcctgcaagtaaggttgtattgaatactgccaaattaaccccaagactggctgcacctggttacaatcctagcagcaatgtattcctagcaatttggtattatccaacatgtacatttttgtctattgggtggatgggaaatggagtctagtggtggtttttatttccatttccatcagagccagcatggtaagggaggtgccccatccagcatctgtgcagtgcctgaagtgccaggtaactggaccatttcatccaccgtggctctctcctccctctgcaagaaaagtacaagagtgggtcacaggtcataagacaagccccggcatagtccatctctgcctaacagccacctcacactgaatcccaatcaatctccacataaaaacgctggcttttgtacaaacagaggttccggtaaagagccttgtgactttccttccttgtagttactttctcattactaggcgatctccccaaaataaaaccagaaagcagaaggccattccaccctgcactcttgttgacatgatgtggggacaattgtgtttccacttgggctgaaaaatgtgctgcctccttggtaggaaagattggggaatacgtcctttctgtgctaatgggtgtgtacgtccaggtctgcaagtttacactggcagtagttgagattcacacaaaagagcagtgcctgacaatgcaaggactggattcacagacggtgcccatcaagataccaaagagccgataatgttaggaaattcgtcatgcagaattagctaacgatttgattttgaccagttacatgattggcagtttattatgaggcagaggctgtcattacgtcacttgaagcaactcgtctacagcagctgaaggatggaggaattgaaccctaccccatttagtggctgaattccagtaaatggaaagaacctagtccaagcttgtccatcccacaggactacagccacatgcggcccagaatgactttgaatgtggcccaacacaaatttgtaaactttcttaaaacattatgagatcgttttgggattttttttaaagctcatcagttgtcgttagtgttagtgcattttacatgtggtccaagacaattattattcttccaatgtggcccagggaagccaaaaggttgaacacccaggcctagtccattattgacagaaaatgttaatgtgtctattaaggaaggaaagctcgtaatttcttgcttcagaagtaatcactcaattctaaattatcctctcttgttttgtactccatttattctgactttgagcaggcaccaaacctttagcacttaaaagaaatggagattggcgaaatcataacaaaatgatagaatttaaattctggaagttggaggtcacggagctcaaccccttcactttatttttattttatttttttgagacagagtctgactctgttgctcaggctggaatgcagtggcgcgatctcggctcactgcagcctccgcctcccgaccaaccccttcactttagatgtggaaactgaggccccagagatgacttgcccaaggggacggtatagcccttcaagacaaatactgtctgaagtcaagttttattattgtactactaaccatttcctgtcgctggagtcatagatctcagccggagctggattctatgttagcttctttgatgaatggatttctcccaacagtgggcctggggtcagccatgctgtgtttctgttagatgttccaggagcccttgctgctgctgactgggaggtgctggagctcactggggtgaatcagttcatttttcattttctccaccttgacttcatggaaggtcacatgaggtggaattgggtaattacttatctactctgaaaacacacctgtatggatttgcacagaatgtgggcctcctgtgctgctgctttgtgctttgggaacacagtggggagcttgaggcctgtggggtggagcctgccttggttgcaacccagccccggcctgctcaggcccgcccctcctcccctctgttgaaagtgtgctttaatgaacagtttttctcatcgttatcttaaatgagatgaagggaaaagcaaagtttttatattaggaagattatttggcccattttttctcctctcctctccacagggacatgaactactgggaaaaacgagatttcttgaaaactctttgacatctgggtgtctggtagctttcaaattcccagaccctatgattccatttcagactctaccattagatgccctagagtctgtggaagtcagtatcctctccacagcctgttggaagcctctctgctggcccgggacagaccatccttcccctgcgctctgctgtgttggggcccagaaggctccgcaacaagtggttgatttaaaagaaaacctggaattttaccaagcagcttacactgtgttgactgaaacactcagaatctgccaggcagcaaacagttgagtggccacccaacactttactccacccaatcacacaatgggtccttaaagtctctccctttaaaaacaaaacaggctggcgcggtagcttatgcctgtaatcctagcacttcgggaggccaaagtggatggatcacttgaggtcaggagttcgaaaccagcctggtcaacctggtgaaactctgtctctactaaaaatacaaaataataataataataataataataataataataataatagccgggcgtggtggtgggtgcctgtacttccaggtacttggaaagctgaagtaggagaatcacttgaatccgggaggcagaggttgtggtgagctgagatcgtgccactgtactccagcctgagcaacagagtgagactccatcttaaaaaacaaaacaaaacaaaaacacacacttgccaggtgcagtgtctcacacctgtaatcccttgaggccaggagtttaagatcagcctgggcaacaaagcctttctcttcaaaaaataaaacaattagctggcatggtgacgtatacctgtagtcctagctacttgggaggctgaggcaggaggatctcgcttgagcccaggagttcgagactgcaagccaactgtgacagccccattgcactgaagcctgggagagcaagaccctctctcggggaaaaaaaaaccccaaaaaacccacaaaaaacttttctgaagtatgattgacaataccgaaagctgttcttatttagtgtatacaacttggtgagtttggagataagtatacacccgtgacacgatcaccacaatctgtgccacaaacctacccatcacctgcaaaagtttcttactgtctgctttattattttgtttattcatgataagaacacttgacataagacctaccctcttagcaagtttttaagcataaaatacagtattgttaactgtaggcactaagctgcacagatttctaggacttatcttgtgtaactgaaactttgtaccctttaagcacttccctgttttccctttctctcaggccctgtagccaccattctactctgcttctgtgggtttggctattttagatttctcatgtaagtggaaatcacagagtacttgtccttccgtgtctggcttatttcacttagcacagtgtcctccaggttcattccgttgcaaatggtaagatttccttctttttaaggctgaataatattccactgtatgcatatagcacattgtccttattcatctgtctgtcagtggacatgtaggttgcttccatgcattccttgggtactgtgactagtgctgcagtaaatatgggtgtgcagataccttttcaagatcctgatttcaattctttgaatatacactcagaagtagcattcttggatcatacagtagtttattgaagtctcttctgcttggaaagtggaaagatgtgggaatttgggtctcttggatatctccttactcagctcatttttagaaggcaaacctgcaactcagttgatgccttagacttcaaagctgtctttttgcagcaaaatcatgattatctagagagatacttgggcaacagatttgtggatgtgaagaagaggaaagctcactgcagaggtctctctgggtcagcaggaggcagcgtgaggaacaccaccagcaagcttgttgtgatgcactgtggtctcttgtgaacagtcccacattcagatcctgagtacaaattctggctctgatactcagcagtcatgtgagcttgggcatgttaatctgagtctgtttttaaaatctgtcaagtaaggatgttaatatccacctccccaaagggtttttgtgaagatggtaaagtatagtgcctggaacatgataggggctcaacgaatgatagtaattattattaataattatgctaataaataatgtggactgaacttcatttcacaagcctgcttccccaagtcagcatttaccagctcctgccttaggctggtagatgagccttcctaagaattcctgtttcatttccccagcatctcctagccccgactcattaaagaaagcatctcactcctgcagttcaagtgaaaagcagtgtttccagaaacgactgttttcttggacttccttttattcttgctttctgtctttttctatcactttttgttactacaaaaatgtttcgtcctttattgtttcatagttgttttgatatagaaaattataagtgcttcttaaataaatggatgaccttggtttaggattataaaaagtatatcccccttactaccaggcatattagttagctaatgctaatatttgtgtcttttgccttttctctcaattttatctgattcagtattacaactagtaatatttgctaatggaaataattaaaagttcattttattaaaatttctgacaaataattaaatcctagagcctcattgaagcactagacaacatgagagttaactgctagcaaaaaataaatttattttaatatatatttttctttaaataccagtcatttctgtttggctgtaaggactacattcaagttaagctcctggaaggcagagttaaagaaaaatgattttgagattagctcactggtaaatcactttgaaaggctaagcctctggtaagctggaaacacagaccagacatggacagtaaccttaatcagcaagaatgcgtcttttctgtaaattatgaaaatttgatgtagtaaaaataaaacttgatttatccacttacctagcagtgcattctgtatactgaatggtacagatgacacttcagcaatttgccctgcccctaaagatgacatctctgcaatgtctagaagcttcctctttaaaatgaaaatatcaacaagagggttggcagcatgaagcttgcatgtacctcttgggtaaattagtttaattgaatgcttttctttgaagagctccaagcaatatacttaaagaataaaactgttctggagcagattgagggagggtataagttgtagtttgacagaaatgagaccctgggagtggaccaggggccacaggatacctaagaacagaaaagaagcacagatgtgaggaagatgcagaggaccaggcaaacacataatagagaaaaaatggcaccttcttctgattctgtttcaggtagtccctggtgccagtttgaagcacttactgattatctgctctcttcttacaggaagggaggggggccagtgtccattcaatgcctgttttgagctaaggagcttgctatgctatgtatatatttttaaaatcacaacagcctttaacattgttgttttcctttaatagatgaggaattgaggctcagagctgttaaatgattgcccagggtcccataactagtaagtgacccagccagaatgtaatcccaggtgtgtctgattacaggtgtttttcttctgagaacagagccttgtttcattcacagccatatcccctgtatctcgaacagtgctgggcacagagcagatgctcagtaaatgttctgtgaattacgtaaccaaattagcgccacagtgccttttatgcgtgagttttagttagttgtggaggtagattaagaaataaaaaggactaacagtagtcattgttttccttagagtactcggctcccaaagaggctcttccaacaccttggacgtgagataaaacatgttctaaaatttatacttttaaaattacggtgtaatcaaaaggccaggcagcccgtaaacctgagaatttgtgcaattggactaacatttctgattcccaggaagcttgcgcctaacagtggaaagcatttttacatgtaaattggtcagttttgagatgagctgataatttctgaaattagcagattacttatgcttgaaggagctgaggtcgccatttgttatctgactgctctttgccctgagcttcgaagccagccaataatgcagtgagtgctggacttccactctttttttcaaattaaagatttaattacagtcttcactgaagatgaaccaagtgtgaaaatacctgatctacttggaatgtgggatcagggaggagtgtgtgggttggagtcagtgcctgggcatttaaatactttcaacagtaacattaagggtgaaattaattatattgtgaccaaatgttggcgtgttggttaggcagagtcagtgaaatttatgttctttttttgttgatcattttttaaagccgaaagggtttttttccttaggagatattctcatagcctatagacttaaatctttaagacttcaaaggttttgaaagatacacatctttgaaatgtgtagagactttctttgtggactggtacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaagtctgtgtatctttttggtcttctagctttagtcattctgatatttctgttagtgtctggagtttagttatacccatccaaggacagagtttaagggtagattcgagctgcctcattaactcgccatcattgagaaatgatctgtttcacatacatgcatttattttctaaatgatgaaaatcttctcttgcagttgtcaaaggcctctgcccccccgacctttgatgacaggaaagtttatcaagtggattcttctctctcgcctgcaggaagctgacccattcttgaggttttggattcgttgccacctctgttgttgtactccctctccactgctgcttaagctgcttcttagttttcctcgccccttccttgacgtggggccagcaatcatctcttctctcttgccagagctgcctctccaccattctttccatgcatacttacctagtgtgctgatcacgattggtctaggaaacagattggctggctttgtctcatgacagtgatctttcatttattcatcaactactatttgttgagtgctggccacatgtaagtcttttaactagtggccaccaaagggctttaaagatagaaccataacatggtccctcctctggtctgtaggggagtcattagatccataatgagagtgaaagtgatagtggcacaaggaaggtggagtactgtgggcattagagaagggggattagaggaggttggcatttgagttgagtgttaagctgtggagattggggaaagtctgtgggactggcatgaactcagcatcaaaggcaggggaccttagaggtctgtgcaggcatctggagcaggagagaggctaggacgtggcataataagcacggggagaagtgggcaatcagattgctcttgaaatgccaggctagggagcttggacctttgcagaaaccaccaaaggtgtttatttaggaaagatgtcagagacgtgcttttggaagcgtaacagccaccagggtaaagtgaagcagagagagaagggaccggatagggcaccagatgccagcagagaaggcgcgaggggatgagggctggaatttagatgagggtgcggtaggatagggtcattggaaaggaaggatatgtgtaaggagggatgtggcagagttcaagagagcaggatgcagcagctgcttagatgtgggagggaggtggagtagtcttaagcttcgagtctgagctggctagagaagagggtgtgagcccaagatccaagagatgagggagggtcaggtttgttattggaggaggagaagttggtaggttcagttttttttgtttgtttttttgttgttgttgtttgggctttattttattattattattattttttagagtcttgctctgtcgccaagctggagtgcagtagtacgatcccggctcactgtaacctgtgcctcccaggttcaagcaattctcctgcctcagcctccctagtagctgggattacaggtgcgtgccaccacgcccagataatttttgtatttttagtagagacagggtttcaccatgttggccaggctggtctcggactcctgacctcgtgatctgcctgcctcggcctcccaaagtgctgggattacaggcatgagccactccgcctggccgttggttagctatttaaaatacagacatagtgctcagtaagaagtcagggaaagagacatacattgtgaagtcatttgcaatgaggtgatatttaaagccttgtgtgacaaaagagaacccagttcagcagttggagaatgtccgtgctcagggttggattagagaagaggtggtcagtggagtggggagggcctggagaaaggagagtactgtggcctgaggactggggaggagggagagggtagggcatgggcacttgtccagtgctcctgagagagggcaggaaagagcagggcaggccactggcattggtgaccagcaggttacatgtgagcatgaggaaagttttctgggagttcgacagtagccagtttgccagcattactgtgtaataaaatagagacaggacagtaggtcatgactaagggagagcaggaagaagggaaagaaggaaaagattagtataaaagaggcaaaaaacttggctggtgtggtggctcacgcctgtaatcccagcactttgggaggctgaagcaggtggatggcttgagcccaggagttcaagaccagcctgagcaacatggcgaaaccctgcctctactaaaaatgcaagaaattagctaggcatgatagtgcatgcctgtagtctcagctactggggaggctgaggtgggaggatcacctgagcccatgaaattgaggctgcagtaagccgtgatagtgccactgcactgtcgggctgtgggtatgaaaccctgtttcaaaaaaaagcagcagcaaaaaactaaatcctgcgtttcacacccattatgatggctgtcatttaaaaaataatcagtgaacggaaaataagtgttgctgagatgtgggtaagttggaactcttgtgcattaccagtggggatgtgaaatgatgttgtggaaacccatatggcagttctcaaaaaattaaagatggaattaccatacggtccagcagttctgctctgggtaaataccccaaagaattgaaagcagggtgtcaaagagatatttgtacacccatgttcatatcagcgttattcaaaggtggatgcaacgcaaatgaccattagtgcatggatggataaacaaaaggtgtatacttatacaatggaatgttatttcgtctttaaaaggaaggaaattctgatgtattctacaacatggatgaaacttgagaacgttatgctaagtaaaataagccagacacaaacggacaaatactgtatgagtccatttatatgaggtacctacagtagtcaaaatcgtagagccagaaagtagaatggtggttgccaggagttgaggggagaagaggatggacagttgttgtttaatgggtacagaatttcagtttgggaagatgaagaagttttggagatggatggtggcagtggttgtgaatgtacttcaaatgcatgtatttcactgaacgctacacttgaaaatggttaagggccaggtgtggtggctcatgccggtaatcccagcactttgggaagctgaggcaagaggatcacctgagcccagaagtttgaggctgcagtgagttatgattgagccattgcactccagcctgggagacagagcaagaccctgtctcaaaaaaaaaaaaaacaaaaaacaaaaaacccaaaatttaaaaggccatacagacaatttttaaatgatgaaatgataaatgttctgctatgtgtattttactacaataaaaaattaagcaaatgctggaagaagccaatttgttgaccaggggaagaaataattaaataaaaatttatctcatgctttggtaaataactgccagcctttctttccttaagttcagagcctcgctctcttgacccagtaccaacaggccctttctgggatcatctcacccagagatcataggtggttgttctgagaagccccttaagaaagtctacaattaagtttggcttcaggtgggctgcagctagggagaaaaaggaaacccttttttgttttccctttaatttttattttagattcagcgggttcatgtgcaggtttgttacgtcagcatattgcatgaagctgaggcttggggtatgaatgatcctgtcacccaggtactgagcatagtacccaacagttaatttttcaacccttgcctccccgccagtagtccccagtgttgatcgctgccatctttatgtccatacccaatggaacatcttttcttgaaggcagactaaaatacctgttgaaacatgagcatgagctcacctgtcctgaaacaattaaaaatatcataaacacctggagagaagaaggcacagtaacaataacattccatgaatgccttatattgcctacagactaaacctctttagggttaaagtcctttcttggggctaattggacagaagataccacaaaaatgttttaagaaatacatgtattaaagaattttagcaattggagtcttatgcaatgtatagaaatattatttcagaaaagcctacacagtctgtgctgttattttcttatttctcttcagccctaatgtgaaccattcctaaacagtgtgcacttgcttctgtaatctgaacttaccttatcatccatgatggccgtgttatatttaggtggtaaaataacatgtgcaactttgagtaggcatgtattctcctgtctggaaatgcctaaaatgttcaatcttgattgtttttcgatccgtagatgttctatttagatgtgtcctggtatttgcttcctccttctattttagaagaaaatattgagctgagggcagtggctcgcgcctgtaatcccagcactttgggaggctgaggcaggtggatcacctgaggtcaggagttcgagaccagcctgaccaacatggcgaaacactggctctactaaaaatacaaaaattagccagatgtggtggcgggcgcctgtaatcctagctacttgggaggctgaggcatgagaatcacctgaacccgcaggcggaggttgcagcgattggagattgtgccactgcattccagcttgggggatagagcgagactctgtttttaaaaaaagaagaaaaagatgaaaaatattaataatttatgaatcttaaattttcattaatgctagttataaagaaacagaaggaaatagttggcatagtatgataagccaacattgaagttttgtgtgttacatgtaatgttcaccctaaatagtattaatagttgctttttgaagaatatgagtctcccagtagtaaagagaaaataatttgctgtatgcaatcctctaccgtgctactagcatatcatttgtgccacaatatttattttcaaattataagctgcaaattctataaaattctacttgagaaatggcttgggaactttctctcatatccacttaattgcaaagtgtcagaatatttttatttttggagatggagtcttgctctgtcactgaggctggagtgcaatggcgtgatctcagcttactgcaacctccacctcctggcttcaagtgattctcctgcctcagcctcccaagtagctgggattacaggcgcacaccaccacacccagctgatttttgtatttttagtagagacagggtttcaccatgttggacaggctggtctcaaactcctgacctcaggtgatccacccgcctggacctcctaactctccgggggttacaggcgtgagccaccacgcctggtccagaatatttttaaatgaaaaactttctaaaaaccatatagctaaagatgcacatcctaagtgtaaatattttgttaatcattgtgttttattagagattatataaatctaaagtgaaaggctaactgcagtttgtggattagataggaaaccaagctcattggcgctctggatgagaaggcagtgttgacattattgtgaccagctcctctggcagtggtgttgactccaaaactgtaatcctttttcttagccttaacgagatgcccatcaaggttgggatttccatcacaccttaccctttcagactggagcatctgtgattcttctgcaaggctgctttaaaattttctcatactgcaaaatatctggacagccaacctagtttgtagagtggcaaatgtcacagcctactttatgggtttgattacttttgtatctgagaaaacagctttcccagaatcaaatgataagtctatttcagagacgactcgtagagcatcttctttgcccagcctgccttcgttactgagatgatcacgtatatatttaagtctgttttcaaatgcacttgtggtgtgtgtggccaacccagtcatggcacctatatgtggatctgagcactcatttgcattgcacagagtccctgaggaactcattaaaagctgggggcctttggcctgggctgacagggtcctggtgccaccacttgtcagagggtgtgtttgatgctgcttttccctttgcctctgtgtccaggctttgcatagagtcactatgtagtcactacaggcagaattgattcaaacacttgtactctaaactccttaaactggttttattgttgttgttgttgttttgttttgttttttgttttttgagatggagtcttgctctgttgcccaggctggagtgcagtggcactatcttggctcactgccactctgcctcctgggttgaagcgattctcctgcctcagcctcccgagtagctgggattacaggcatgtgctactatgcccggctaatttttgtatttccagtagagatggggttttgccatgttggcccaggctcgtcttgagctcctgacctctggtgatccacctacctcagcctcccaaagtgctaggattacaggcgtgacccaccgcacccagccaccttaaactggttttagacttgagactgtctgccagtgcatgcatgggttagtcctgttttatggttgcagtgtgtcttgtgaaggctacattccattgtttttctcactcatgcatccattattaaacacccactatgtgctctgcactgtgctggacatggacaatggatggtagacattcgcagctcaatttccatttacccgaggtttgtcttttaccttgtggactttgtgtctttgcctccaggtggttctcctggctctttgccctagcctgattcagtggagtcggcttgcctgttggcccagcctcaggaatggttaagtgtcactgaaggcctatacatgatgccgtgaaaagcacaaacaataggctcaggttttagcttggaattcattttaactttcagtcttttggtgtgtaaagagggatgaagaaagcaattgttgactttccttcacatcagaattgaaacttgtccaagaacattcagaggtgttgggtgtgttgtcactttttttcctttctcaaccaatgtttaataaaaatcctattaatttccaatggagtacagacactcacaattctttcctggagaagagtataggcttctgccagaggagaggggacagaaaataatgagtaacgagtgtatagacctttagggtttacaaactattttgtctccttgatcctcaatgcaactttgtgagatatttattaccttcctttacaattgaggaaactgaggcacagggtgtttattgaggtgccagtgtggatggcagagctcctggtctttctggacaattctcagacggtggctgctcctggctgaggggtacgagctgggcttggcccagcctgacaggtactcctaagtgagaggagccagccagaagcaggcctccctcagccctcctgcctagcgtgcagtgtggtgggaaaacagtctcccagaaaggaggctgtgtttctgctgcctcttcgagctcaagaaagatgaagtagggtggggtggggcaggtgtagacaagggaagtggagtgggggagcagtgctgagaagtgacgctaggaacagggctcagttcagacagcatcaggtgctgagatgtggttgtcaccgggccacacgtgtgggtgaccacaggagggaacgtagcacttaatggggccccacgccttgtgtagaatcctcctaagtgctctactgtatccccaattttacacatgaggaagcagagacatggagaggttaagggacctgtccaaggtcttcaggtagtaagacagcccacctccggagcccacacctgacccctctactctgttgcattctgacccagggacagtttctggaatgcctcgttttaattccctttagtaacaacatcctgcagcaaacccacacactgggtaactctttgctcttctctcctcagaacgcaagcctcgttgtgacagggctccaggaacccagtaattgtagattaggaacagatgagacccgtacttatttggagacattgacacctgtgccatgtacttcccagagttcccaacttttaggacaaacttaggctcaaaaaccacagattcttccttcctccaaatgctagtctgaagggatggtttgcttgatcgtgggataataatgctattttctgtttggtttataaagtatgttcacagacattctggtgtttgatttgatgccagccatcttctcacctccctcctcaaaaagattgaaaaaggcagaactgatgttaacaaaggccgttcaagtgaggaataggttgttttgcctcttggatgtgaccttcaggctattacatagtaaacatgtattcctggttctctgaaaaaggcaacatgtatgtgtggcctggaataaacagaccttgtactaaatcctgatatgattctgatgcgttcaaaagcaagaatcttctcacattaagacatggagatttagacagctgacagaggaattaaggaaactaatatttgttgagtaaacattactccagtcatcttcactactatctgttattacccccttttcacagatggagaaactagggcgcaggatgcttaaacaatgtcccaggtaccagaggagttttcttaaaagtctaggtcgtgtttattttactggagagcagaggagagcaaagagttagccagtctgtggttttactgcaggatgttgttactaaagggaattaaaagccccacgatgattaggtgttaagacttaatatattttggttaaaacatagttttagagtgactttgactgtttggattgcgtgtatcaccaaatgcgacacccctggacgggactggtcaactgagtcagtaaaagtgagtcagcccctcgtgtgcacgcttgctcacctctgagagggtttaggaagagatgtcagtgggaggaaagttcccacaactgactgagtttgggggcaagggagcagtctggagcatcaccattgctgacaggcaagaagggttttttggaaggtgaggagtgaggggagaggaggtacttcaaagggtgctgagcccctatcagggtagggctgctgccatggacatgttgattattcatggctttgagacacaagttgcttgtggtgacctcctccatgaaacaagcagggaatttggggacccaccagctttctatgctgtggtccaggagggcttgggtggggtggggtggggtggaggtggcactggggacccaccagctgccatgctgtggtccaggagggcctgggtggggtggaggtggcattggagaaggaacgcctggccgtgagctaattttgcttgagtccctggttggggtataaggctgaatgcgccccttctttctcttccctttttgcataccatgttaatataaacaaaaaaggcttcttccctttgcttctcggttgaactctgtaagtgggggagtaagtttgatgggtgcattatcacttagtttcacaagcagcagggaaactaatctgcagctacagtaggaccagactgtgagcccagattctcagactcccgggccagtgctcccccaacctctgacatgctgcagaaggatgcttgcttggctctgttccttttgagagttaaaaaattggcctactattattttgtgaattgtgtgtacattatgttttacataaaatttagagggaaagaggtaatgttgcataaatatgtactttctgttaagttcacctagtttttaaagtatgctatttgccagtgcttgcaaaggttgtgatagttgtatcaacgaggaagcactgataatttacctgattccatctataggatctttcatttaatttacctgatgccatctataggttctttcatttacagtgattggccagttctctctacaatacgcaaagtgcagagctagcccccttcaaaaccgatactcgattttaaagctgataactaagatatggtgttacggaaaacacaatcctatgctccactctctcatcactactctttaattgcactcgggggaaaaacacatttaattgtttcaacgatcattacttttttttagtaaatttatagtaaatggaggagattaccaaagggctatttttttctcagcttgtggtttctaattacatcagttacagctcagccttcttcttaactagagtgcaggcatgaactggaaaagaatgagctaatccatgatagatcaggtggaataaagatctccattcatatctttaccttttatcccttgttctgagtgccaagaattaatgctatttgaaagtacaaactgaacctgccaagcttcggacagctaagataatcctaattattttaaatgttagtgagaagggcagcagttccactctggaaaagagttctattgtgaaacattaaatatatgctaagtggtattgattgcacatgattttatttccaaacactatggttatcatgaagtggaagaatttgttgtttaagaaattttcatcagcttttcatcagattctttcttatgcctacaaactctaggaaactgaagaggccagcaattttgtttgtctgccttggcagtcagcatctagatgaagagttggtaacaactgaaaaatgccacttgtattttattttaaaatggtttcttaggagtttaatagtgtttaacatatagaggaaggaaaaatgtttttaaagcatgaatatcctgttttctcacatcactggaagagaattattcgttccagtccattgacttccaacagatcattcaagttaaaagtcaggggtctttgcaatgtcaaaagatttagcacttagagttttgtggttttttttttaagaaggttttcttttttgacagtataaatatttttcaaaaataatactcatggttagatggcatcaaaatcatcttgaagtgttttttcccctcattggtaagaatgatcctgtgtaaggttttctgtttatttttaaatcataataaaataacatcccagtagcttcggtagacaaataggcttcttgagagaaaacagatactagatttgctggttcaaacaagggtcagcctcggaggtttacccacctttcattgtaacacaaaaaaatatcagatgggcaagttttccttttttcttttccttacttttcagtctctgctgtggtgtgcagaaataatttcttctatttctgtaaatgctgggaggctatcaatgattatagggtagtataatccttaattgtttattgcctgtgaatgcttcctgcccccaaccccagtgcagctggccccaactcccttccccaagcacaagagcagtacactaacatcttcactgacggtgtgttgagcatctcaggctcaattattcttcctttcttcggggttattccccagagtggaattaccaggtcagaggggctgaacagctttatggttcttattacatgtcactagattgctgtccagagagattgaaccaatttctagtgctaccaatactatctgttcccccacagtgccactgacgctaggagttagcatttttacaaaatgacctaagacaagacttttgagttgaaattagcctggtgtagggccccttagaatcaaagagcgaaaagcatcattttgatttttgaatttttaattggtatgaaataatttacaacggtcaactattagccttctccttccaaaagtttaaggaagctgcattaaaatggaaaaggtacctctgagggacgatctttaaggatggtagtaaaagtgattttggacattagtcactaaggaaaaacacactaaatcttttcatgtacctagaactctatgaggggctatacttaaacagatactatccctaacttcaacagcctattatttaaaaacaatgctaagccttgaacaaatgtaaaaatagcatgggtttaaattttgagtggagaaacactataaacaatacggctgtttttcaaaacagggtgagttttacattttctctagagtgcagtcatgcattaaaagtatgcttggagccccgctagtccatgcaggtaatattctgcatgctttgtggccccacgtcgcaagagcactttccaagaaaatattcataaggcaagttagagcaaaagggggatattgtcaaattcctttcttttgcaaaattcccactcctccccttttcagtcccaagttggctaaatgaggagagggcatctcccggggcatctcccagtcagctgctaactggaaacaggcccagggctctgaacatgttgggagaacacatacctattcctttacaagcctctgcatcagcttggcaaaggtccgttgctttgcctccttaaactcacacagggattgggaaggttcagctgccagttctgaaatgtggggcccaggagaaggttggtgcaggggccagagcacgccagagtcagcctaatcagtacagtgctgcccttgacagcttgcacaggatccctgtgttaaacggggagagtaattctctcagtgaatggtttgagggtgaaatacctcactaaagtatgtgtgtggcatacaggtagtagtcagtaatgtttactgttcttctccatagcttctatacagagaaacttctgtcactggttgggggtggggacattaacgcacggactccaggaagctcttagtcggctctccagatctgtatagtaacaagatctcaaagcagtctgctgcctttggaaaacatttctctgtacatatatatgacaaccaggtgcatgtatacaattaataaatcaccttggatttgcatggaatttaaatgcatataacaatacaaatttagtaagatacttttatgaactgtaataagatgaaggcttcagatttcctagattcctagttttggttgctatatttatatatgcatatgcgtgcttttttgttatgaaatactacttaatgactccctttaaattaaaaaaaaatattttcctatattttaaagcttacaaacttatcctttgctttttatttaccttattaaagactaaacaaatctatcaatataaaaagtaaccacttgtcaggaaattgcctaaattgtttttcaaatttattcacttactgaattttcagatcatctctttccttcttggatattgaggtagctgtacaaaactatccatttgtctatctgtctacccatatgtcacactggaagaagggggccttctgaaagaatgtggtccagtggagtggttaagggcctgcttcttaaatcctagctctgttcttttatttctgtgtggtaccactagctgcagcaaaccttttccaaacccgtaacgagtgtaaatagtgttcagttgtaaaaaggtctcttttcagcatggtaatataccttattaaattccaaacataataagtattgatggcaaacacatcaggacccagtgcagcttctactatgatttagttctctacaaatgacttcagcactcagctcccaatgcattttgctaattacatcatagatttccctattgatgaacacaagctgaattaacacaggagcactaatgtaccctttcaccattattgttgtacaagaagccgtggcagatgctggcagttagttacacaaacattagtattaacgattggccatttggaattggtgacaaactactgcccggcagaatcctgaggctgaaaccaatcaggaagttaatgaggagagaaattaccactgcagcttccccttaattacattcacactaggcaggaagggagttctgggggtggatctaaactcagctaaggttaagaaggtcagagacccttttgcttaagttttttatctactgtggctgctaaggttgcaaaagttgcttaacacattattacttttgcatccttcatatttaatgtgggttttccagtggagttttatgttcctaggtttgctttcacaatttatctgacttctattttagtgtgatgtaatttatttacttttctgtttttacaatttttctctcccatttactgtcttttactttttaaaagttatgtatgctgacatccctttcccccgtctttgtcctgttatgccaagagaaataatagtaaagttaatatgctatccacttcacctgctgtatcttgaaaaagtagggtgggttacctgtcgtggtggaaatgcatgggtggagtcttgcttgaggtaatgtgtcagatggatcacttgacaagtttcatcagcatactttgcataaaggggaggagtccggtgaagggtggaaatagtttcccaaagaggatgcagccgacttgttttgttttttaatgaacgttaaactggaactctgctatctagcttactcctttcgttaaataggtatactgtgtagaatactatttttttattctaaagaaatgctaggagttttaatgagtgtctataaaaacactttcaactcagaatagaaatggagagcgtcactttctttgttgtaacctaattgaataatgaatgtataaagaccagccacttttaacattactccctttctccctttctctctttctctctcacctcacttcccagtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatgatttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggtttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaattttcttgtgtgtatatttggtgagcggtattaaacaggaaaaaagaaattacttgtattttcttcgctctgtgctttgaaaacatctatttgatttcacccccatctgttgtaatcaataacctgaccatcttgttttttattaaatgcacttactcttaatttcatccaccagtggttttagagagaataatgtggagttacctatataggtttgacattataaatcacttcttggggctgaatcgtatagcggtatcgattgatcctgatatatcacagaaatttactgtcacttctgttttcaattaaagatacaatcagtcagataatgacttaattggattttacagaagattgagttttattgcccagtgctttacgagtttagttaaggaagatcattttatcacacttgtcaggctgctgctactgcagccgtgtgcccttcggcgggcggctgtagctgtagctgttgtgacggctacggcggaggctgcgggcgcgcggggaatggagccggaccgcggagtcgtcacctccaaggtgtttctagtggcctcctggaagatgatcccgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccaccggcctcgcctaacgccgtttggtgctgcatccgagcggcctcacgcggtcccctggaagggccactcccagcgggagggcggggcccgggacctccgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggttttgcagatgtttgggtgctacggtgtggggaaacccaggcaggagcgccaggcctaattctcctggactcttggtgagcggccgctactccacgaggggctagaagcaaagggagcacgcgcttttccccaggccgcctcttgctgccgcagtggctgagggcgctgatgacccctccccgcttccagcggacttgacccgctggctgacaacccaccgcgacaagcaggcggctgggttcgcgccgccgccccggggcccttggctcaaatttcacctcgagtcctgcagaccctgcgccactgaattggggcccaggacgcccttggtgacactcgccttcttgctgccacaaccaccgtcatacccgcagccggggctccctccgctaaccacgcttggagaccccaatcggggacagaggtgggagtcggaccccccctggcctgcactgccgt

SEQ ID NO: 14419 - DNA, 7362 bp, Human
tttggaatacagtttcagtttctccctgagttgagaatagaactactatatgacccagcaatttcactcttaggtatatacctaaaataatttaaaacaagtactcaaacatagaagaactatttacagtagttaaaaggcagaaacaacccaaatgtctatttatggaggaatggataaacaaactgcagtctatatctacactagaatattgagccataaaagcagtgaagtactgatacatgctacgactcaaaagattagaagacagatacaaaaggtcaatattgtatgattccatttttatgaagtaggtacatccactgagacagaacacagattggtggttgccaggcctggtcgaaatggggaaggggcagcaactgctttaacagggtacagggttttcttttaggatgatgaaaatgttttggaactgtatcgatagagatggtggttgtacagcattgtgaatgtactaaatgccactgaattgttcactttaaaatgactagttatgtcaatttcacctcaacaaaaaaatgacacacagtactcagattttaaaaagcatcatttcaccaagattccatgaattaatgtgagatgatcaaagaggattcagtagaatcgttcaacttcgaatgtaaaacagtcctaaactcaaacctttgtgacactaaagtggggagatggtatgtgatagttttagatagtaaaaattattcttgtttacttggtctcgaactcgaacttttttgaggcggagtctctctctgtcgcctgggctgcagtgcagtggtgcgatctggactcattgcaacctccgcctcttgggctcaagcgattgtcgtgcctcagcctccctagtaactgggactacagtcgccccccaccacgcctggctattttacctatttttggctattttacctatttttattagagacggagtttcgccatgttggccaggctggtctcgaactcctgacctaagatgatccgcccgcctcggcctcccaaagtgctgggattacaggcgtgagccaccgcgcccggccttgccctcctattttggtaccgtcagatgcaaagtgcctgggacagaagtggggctccgctggcgcccagctccaaaacccaggcagcgtggaaaagactagacagggaaggggttagccctcagaattacacgcgggtttgccttaccagactaccaccactggcacaacctcagacccacacccaaccgactttacctcccaggccctgattaatctcgcccggaagtaccgcccacccatgctcacttccgctatcccgtacttctgctcatctcgcgagaactgaaagcgcctatgtgacctgcgctaagcggaagttggccctcttttccgtggcgcctcggaggcgttcagctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtattaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgagccaccacacccagcccaaaattattttttggcttacaaaagaagttgctttaaacttctgtttcatctgtaggatatggataacaatagttaagagttgtgagaattagaagttagagaccttactcagaatactagggagcaggtgttagggattttggagctttaccttttaagaacttttgtccatatagtagacaacatactcaccagtgaggacctcaaatagcaatatttctgtggtgaaatttggggatatttatgttaaataaacagcatgtcagtcaaggttgggttttcctgacaaaatttgaaagaatttctctggattttggttttcaggactggtgtgacttaacatacatggcatagatagtatacgtctgttaagtcagtaattacacttacttgagcacaggtactgttcaaggtgctgagaatacagtatagacaaattcctacccttatgaagctgatgttgcaaaaaaaaaaaaaaaaaagcaattgacaaataggtggcagttgcccataatcatagccctggaaataatccgtataatacaagcgtggtctggttgatgggtatttttagatggttcttatgtctatagtaggaggcttaacattttagcagaatctgaacatctgagcatttagcctaaggcagttaactcctacaaagtgtccatgaaacaaatacatctgaaaaggcctatgctccaatgcagatctgtaatccatgagcagttttggagtacagatcagattaatgaagatactttaacaacatgccacctaatctgatgttaatagttaacgttacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaactggaaggtagtaaaagttagcctggttatttttcaggacttggtttcccttatatttttataatatttaaccaatcttctagatttctgtggaggggcaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgtttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcagtgaaaaatgcacaaagtatgtacttttttctaacagttctatgctgactagcctattgtgacaatatcaggatctttagaaggtggcacattaggctttaaggttgaagtaatgcaagctctttgttggcattactgtaataatagctttacaaagcagagttctaaatgttaaatgtacatgtgaatcacctaggggtctggttaaggcgcagatagtgattgatagaggagtggggacccacatttttacattactaaaaagctcccaggtgttaggccggtagtgccagtccctcgatgcctactaagattcttaactattcctcttactacatggtgttaaaaagctacataacatgaaaagaatcttagttggcaatcaataataatatgcagaacttaaaaggcaaaggggatggccaggtggggaggccaaggcaggtggatcacctgaggtcaggagttcaagaccagcctggccaacatggtgaaaccccgttcctactaaaaatacgaaaattagcgcatgcctgtagtcccagctactcgggaggctgaggcaggagaatcgcttgaaccagggaggttgaggtttcagtgagccaagattacactgttgtactccagcctgggcgacagagcaagactcccatctcaaaaaaaaaaaaaaaaaaaaatttagcacaagcagagagaggaacttaaaagccacaaggtgagtccagtgttatggtccaaagttttatattaaccagttcttgtttatgatgcacaaaacatgagaaccgccctgctttctgaaaattgagtgcagccacaaaataaggacagtctgtttttccttagatttttttttttctttgacacagggtttcactcctacgccccggatggcgagcagtggtatggctcactgcagccttgaccgcctgggaactacaggtgtgcactgcggctagtttttgtgctttttgtagagttttgctatgttacccaggctactcttgaactcctgggctcaagtgatccgcctgccttggcatcccaaagtgttgagattactacaggcgtgagccaccatacccagttctccacacacacgcaagtcattctgacatgtcgttaactatgcaggttgtgatcaacctgtacaattcgttcgttggaagaaaaaaaaatcgctatcgaaccccaaaccaatataaggtactgctgagtaatctggactaatttgaaagattgcttttagaagttatcaggattaaagttgcatacagtgctacaagtcattccaggtacttctaaatctttccataataatgtttttgtcttgtaaatttttagtggtaccctctctgtggtgggtattggaaaaagcctttaaaaatttataacaagaaatcagtcccaatatctaaatggcagcagcagactaaagttttcaaggtagagatct

SEQ ID NO: 14420 - DNA, 6032 bp, Human
  misc_feature (1)...(6032): n = A,T,C or G
ttagaggaattcctaagttctcactactttcacatattattttatctactgtggaatgataactttgttaacatgaagcttttcaagctgtcactgtattccatcgggtatttcggttggttcatcaaagtgaaatgaaatgaaaatgcaggaaaaacaaatgaatagaacacaattaagagtaattcattttggccaggtccggtggctcatgcctgtactaccagcagtttgggagctcaggagttagagaccagcctggccaacctggtgaaaccccgtctctactaaaaatacaaaatgtagccaggcgtcatggtgcacgccttctggtactggaaggctgaggcaggagaatcacttgaacctgggaggtggaggttgcagtgagccgagatcatgccactgcactccagcctgggcgacagagcgagattccctctcagaaaaaaaagactaattcattgaaacaccagtttgtaaagcatcagggatgcttttctcttgttaactacaacattgttgttgaaaactctgctaaaatttcacattctttttttaaaaaggtaaatgaattttaataacgtattatgcataaaaattatttaaagttgacattaatataaaacttattgagctactttaaagtttttttcacttcctttttaaacttttattttaggttcgggggtacaagtgcaggtttgttacataggtaaacttttgtcatgggggtttgtggtacagattatttcatcatccacgtattgagcctagcacccattagttattttccctgatgatctcccatctctctgcctcctctctctgaaagtccccagtgtgtgtcgttcccgtctgtgtgtccatgtgagttctcatcatttagctcccacttacaagtgagaacatgtggtgtttttctcttcctatgttagtttgctaaggataatagcctccagctccatccatgtccctgcaaaagacatggtctctgttcttttttatggctgcatagtattccatggcatatatgtaccacattttcttgatccagtgtgtcactgattgccattttggttggttccatgtctttgctattgtgaattgtgctgcagtgtacatatgcatgcatgtgtctttataacagaatgatttatattcctttaagtatatacccagtaatgggattgcagggtccaatgctatttctgtctttaggcttttgaggaattgccacactgtcttccacaatggatgaactaacttacactcccactaacagtgtataagcattcctttttcttcacaacttcaccagcatctgttattttttgactttttagtaatagccattctggttggtgtaagatggtatctcattgtagtcttgatttgtatttctctaattatcatgaacagacagttttgaaatttttacaatcttatgaagacaaatgaatacagaattttctgagctggggtacaaatggcttttctggggcaagattatagagattaacaaaatgagatggggagaaattgagccacattattgtcaaatttagcttgctgggagtaaaaaacaaaaaaccaacaaaactgaagtcttgcacttattagtaactatttctggcttccttccctctgctaaacatggattgtcagatttctctctgtgagttgtcctcatccactactagagtcagtcaatggccctacactgtattccctggcaatgattttgcaaggagtttcgttcaggttcttaacactttaagataatgtcaacattcttccttaacttctctctgcttccaatgtcttccatttctaatccgccctgcacacagaacattttatttatccttcttaaatacagaaactactctcaattgtctacaggataaagcaccaaccttttaaactttaccaaactaacttggaaaagtaatttcctgggagaagcggcgtcggcggctggagcagaggcagcagccggaggagcagcagaggcggtcgggagcgatgaagatggcggcggggggcggcagaggcggcggtggcggctactaaggcggcggcagtgagggcggcggtgcccctaagctgctcaagactggcaacgccggcgaccagcacggaggcggcggcggcggcggtggcggtggaggaggcggggcggcgggggcggcggcggggagaactaccatgacctgcacaaaacccctgcctccccagttgtccacagcaggggcctgattgacgatgtggtggaagctgaccttgtggaggccttgcaggagtttggacccatcagctatgcggtggtaatgcctaaaaagagacaagcactggtggagtttgaagatgtgttgggggcttgcaacgccgtgagctacgcagccgacaaccaaatatacattgccggtcacccagcttttgtcaactactctaccagccagaagatctccctccccggggactcggatgactcccggagcgtgaacagtgtgcttctctttaccatcctgaaccccatttattcgatcaccacggatgttctttacactatctgtaatccttgtggccctgtccagagaattatcattttcaggaagaatggagttcaggcgatggtggaatttgactctgttcaaagtgcccagcgggccaaggcctctctcaatggggctggtatctattctggctgttgcactctgaagatggaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggccacgggcccccccgacctcactacgaagggagaaggatgggtccaccagtcgggggtcactgtcggggcccaagtcgctacggccccccagtatgggcaccccccaccccctcccccaccacccgagtatggccctcacgccgacagccctgtgctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtatttctctttcctttatgccattttttggtttttgtttttgttatttgcaaaagatcttgtattccttttttttttttttttttttttaatgctaggttcgtagaggcttaaccttaacggaaacgctggaagtctgcagggggagggagaggggaactgatatctcccaagattaaccttcactttaaaaaaattattgtacatgtgatttttttttcctgttcatacatttgtgctgcccatctactcctggcacatttcaataaaattgtttggaaaataaacacagcacttgctgggaaaaaaagaaaagaaaagaaaaacaatttccaatatttgttgtctcaaagatactagaatatactgatttatagctacttattttttccaaacaaattagtccactatgaataacctccacagtctctttttgttgttgttgttatctatctgaattctgcccatttaaggtaaactgatgtctataattactcctgctcaagaacttctagagccttctaacatctggtaaccaattccgtctttaaagtacctactaccatgatttcagttttcttgactgtatcctaacagaaaaaaatagtacaaaggggtcacaaatgcagaagaaaagctggaaagatagaatgattaatattcacaaattttagagtaatagatggatagttttattgtaattggaagtgtggaggatttctgtgaattggtatactttttttttatactttaagttctagggtacatgtgcacaacgtgcaggtttgttacatatgtatacatgtgccatgttggtgtgctgcacccgttaacttgtcatttgcattaggtatgtctcctaatgctatccctcccccctcccccgaccccacaacaggccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctataaaggacatgaactcatccttttttatggctgcatagtattccatggtgtatatgtgccacattttcttcttttttttttttacctaatttcacaatttattataaaacgaccataaaagcctgatgggattttgatttgtattgtgtatatatcaatttcaggagaaatgataccttacaatccagcaatatgttctatacctgcatttatctatatctttttttatatatatatattttttattatactttaagttccagggtacctgtgcacaacatgcaggtttgttacatatgtatacatgtgccatgttggtgtgctgcacccattaactcatcatttacattaggtatatctcctaatgctatccctcccccctccccccaccccacaacaggtgccggtgtgtgatgttccccttcctgtgtccaagtgttctcattgttccattcccacctatgagtgagaacatgtggtgtttggtttttgtccttgagaaagtttgcgaagaatgatggttttcagcttcatccatgtccctacaaaggacatgaactcatcattttttatggctgcatagtattccatgatgtatatgtgccacattttcttaatccagtctatcatttatggatatttgcgtggtttcaaattttttactatttggaaaaagggcacaataaacaaatatgtgcatgtgtttttatagcaccatgattaataaacctttgcataaatacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14421 - DNA, 24000 bp, Human
  misc_feature (1)...(24000): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacggaaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagaacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttcttttttcccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatacacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatgtagagtaagtgctcaatccataatagctattattactattggccaggcgtggtggctcacgcctgtaatcccagcactttgggaggctgaggcaggtggatcatgaggtcaggagatccagaccatcctggctaacacagtgaaaccccgtctctactaaaaatacaaaaaaatagccaggcgtggtggcgggcacctgtagtcccagctactcaggaggctgaggcaggagaatggtgtgaacccgggaggcggagcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattatgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagtaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggctgcagtcagctgagatcgtgccactgtactccagcctgggcagacagagtgagactctgtctcaaaaaaaaaaaaaaaaaaaagcagaaacagtctttcttcctagcatatgaaatgagtcacattgtacaatagggtttttttaaaaaaagttatctgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatgattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgtttttctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcctattaaacgataattcatttgctcaacacgttcttattaaatatccaccacatgccaagcactcttttgtgtgctagggataaggcagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagaacacatggacacatggaggtgaacaacacatactggggcctgtgggggctgtggtgggaggagggagagcatccaggaagaacaactaatggatactggccttaatacctgggtgatgggttgatctgtgcagcaaaccactatggcacacttttacctatgtcacaaacctacacaccctgcacatgtacctcagaatttaaaagttgatattttttaaaaaaagaaaatatagacttctgtaggaaggagtttggtgctgtctactttgtgcagttcctgctactaaatagcagctaacctgtattgagtgattactatgtgctaggtatcttaataagcactatatctgaattgtttcatttaatcttcacaataaccctaaggatctaggtcctgttattttgtctccattttacaagataagaaaacttagttactcctaaggtcacatttttagtaagtggtagaatcaacatttaaccaaagttgtaacgctaagacttggattcttaaccgctagagaacacctcaatacttcctcttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcagaggtagctcatgacagaattatgaagtaaggaacaacttgtctgtgaccaccccccaccccccacccccaccttcccagcagactatcttcttggtgccctggctttccttctcttagtggtctctgaagagccagtaaactatgcagggggatttacatttgaacaagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacactgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctatcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttaggcaggctcctggctctcgaactcctggcctcatgtgatccaccctcctcagcctcccaaagtgctgggattacaggcgtgagccactgtgcctggcccagaatgtacttttttgtgtgtttgccctttttttcactcaacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatataggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctgtttttgccttattagtagggtaagaaaaaatacatatgcaagtcctttgtcagaaattgcaaatatgttctcacactctatgcattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgacccgtctactgggaggcaacaataatttagcggtacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgcttcccttagttccttgccacttggacctccccatagggctacttcctgacatggaaactggctttcccaagtgagtaatccaagcaagaaacagtgtgagagtaacacgcaatatgggaaccatggtcttttataacctaaccttagaaatgacatcccattactgctgctgttctgttttttagaagtgagtcaattagtctagcccatgctcaaggagaggggattacaccagggaatgaatatcaggcaggcaggaatcatgtggagaaatcttagtgactgcctaaaacaatggtgccaggccttgatgat

SEQ ID NO: 14422 - DNA, 8180 bp, Human
ccaaccttagagaagctagcaggaaatgtaatcaagtaaatagtgattatatagtgtgatctgtgtgatgatgggagatgatagagtttgctttccctacctcagtgttattaggagcaaacaggatatgtctgaagcagcctctttaaggcatgcagtactctagaaaggtgagtagctgtgggtcggcctctctggctgcctctatgggagcaggagagggaggatttgctgtggtctgcttcttggtttccccgtctgcgcttctgcatggtcccttgttctctatcacatagggcagtaaaagacgcttggcaggagtggcgggttcagcatagctcctcagtaacatagtaagagagggcacactgaacatctgggtggaatacaggtttagttgctatgttaacttttaattagatggacaattgttaatatgaaaatagttttactccttgagcctagaatcttttttttttcttttcttttctttttagagacagggtctccctctgttgtctgggctagagtgcagtggcatgatcatggctcaccgtagcctcaacctcacaggctcccacttcaccctgagtagctgagactgggactgtaggcacatgctaccacgcccggctatttcttttttttaattttttgtaaaggcagggtctccctatgttgcccaggctcgtcatgaactcctgggctcaagtgatcctcccacttcagcttccaaagtgctggattacagatgtgagccactatgcccagccatgtgtagaattcttaaatacaaaagagaagtctatgagaactgataacatactatgctataagaaagctgaagccaggcatggtggctcatgcctgtaatcccagcactttgggaggctgaggcaggcagaccacttgagcccaggagttcaagaccagcctgggcaacatggtggaacccagtctttacaagaaatacaaaaattagccaggcatgatgacacatgcctgtagtcccaactacttgagaggctgaggtggaatcattttttaaatttcttcttaaggtaaatttagaattgcaagttgtatgtaagattatggtggaaatttggtgcagtcttggctcactgcagcctctacctcctgggttcaactgattctccaacctcagcttcccaattagctgggactactgatgcacaccaccatgggtggctttttttttttttttaattgtagagttggggtctcactatattgaccaggctgatattgaactcttgggctcaagtgatcctcctgccttgacctcccaaagtgctgggagttacaggcatgagctactgtacccagcctagatttcttatacattatttgtgaatactccaatatacaacggtttgttgataataataagaaaggccaggtgcggtggttcacacctgtaatcccagcactttgggaggccgaggtgggtagatcacctgaggtcaggagttcgagaccagcctggccaacatggcaaaaccccatctctaccaaaaatacaaaaattagctgggcgcggtagcgcacgcctgtaatcccagctactcgggaggctgaggcaggagaattgcttgaacccaggaggcgaaagttgcagtaagccaagattgaaccactgcactccagcctaggcaacagaacaagactccatctcaaaaaaaaattaaaattaaataataagaaataaagtaattgcatttttttgtgtttttgtttttgttttttgagacggagtttcgctcttgtcgcccaggctggagtccaatggcgtgatctcagctcactgcaacctctgtctcccaggttcaagtgattctcctgcctcagcctctcaagtagctgggattacaggtgcccaccaccatgcccagctaattttttgtatttttagtagggtttcagtatgttggccaggctggtcttgaattcctgacctcaggtgatcctcccgcctctgcctcccaaagtgctgggattacaggcgtgagccactgcgcccagcccttgaatccgtatttagaccatcatttggttggggctaataattggcattttaacatagtgtttccaatcaggtagttcagccgtaaattaataatgacaagcaagagttgaatgccactgtgagtgcattttgaaaagctctggaagcaaggcaacttccccagtgttgtttgatttaacttgtgctgtccttagttattcgagcctagatagaaggagagttggagtctttaacgttcagagtagttgactttgatttttaatgctaggaaaataatttctaatgcagctggacatggtttccagagataattcaaatagcaaagaataactgaaggcagtttgggaacgtgtaaggttgttttcagttgaaggatgctgttggcatttagggtctgagagccatgggctcttgcctcaataatgtgtgaaaccacaaaatccagaattgttccccccataacatcaataacactgagaaacctaattagggagtgccttcacctgcgtgtcatagaagtccaacttagtggcttgcccaggtggaggcttgttttcctcacatcctgagtggcacagaggcaggctgtgcgtggctggtgggggctccgtgtgcccagagtcctgggtaccttctgtcttccacgccaccatcctaagggtgggtttcatcctcactgcttccagatggctgctccacccccacaggagggtgcggcagggcagaaggggtccctggataggaaagaatcatcaacagagagcagcctgcatctcactggcgacagctgtgttacctggtaaccttgcttttcaaaggagactatgaaaaatagttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttacaaattgaagtgggagtgcatgtgagcctggccggaggagagtcccctagcctcttccaaccttcccaccaggctctaatttccttatttattgtatttgcttgtacagctccattttggcaaaagtgaatttagattttctttcacattccagtaagtgtctttttaaacttttttgcagactttgcattttgtaacctacccttgagctactgcattttgactgagatttttaaattttacacaggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttcttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttagagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaagagtgcctgctattactacttgtattcaacattgtactgaaagtgtcaacacagtaaagcaaggaaaatgaaaaagcatgaaaaaaaggcatatggaagaaacaaaactgtcattctttaaaggttagatgattgtatgtatggaaatccaatatcatctataagcagattattagaattaagagtttagcaaatttgcgagctaaaacatcaacatttaagtttttctaagtaccagcaacagaattaaaaaatagaattttaggctgagtgcagtggctcacaactgtaatcccagcactttgggaggccaaggagggaggattgcttgagtcctaggagttcaagaccagcctgggcaacatagtgtaagaccctgtctctataaaaataaattttaaaaaagaaaatggaattttaaatatatataatatttaatcataactaaaaatataaagtttctagaaataaatctaataaaaatatgcaagacctttttggagaaaattacaaagctttattgtaagaagcagagtttaacccttttcccatttagaaaaaaaaagtgcagctcactgccagcgctcatttaattttacgtaaacacactcttggaggctgaagcaaatcttactgattttcaatgtgaaaataaaatataaaaactattcttggagttatttctaaacagaactaacatcagaatcatctgaatcatcagaatcatctctttcagaaaaatcggactcatcgaatgaatcttcggctaactgttgagaacgatgttaacatcacgtgtaggaatactacattttccaggatttgacattttcagcgatcgagaattactatgttttgtaaatggaaataccactactaaagacagaatgctataaatagaatgatgtcttttgtttctaaagtcgatatactagagcgatgtgaaaataatcataaaagcgagatatttcgtggcaaagttatctcggggtaaacgctgcagctgtaagcactgccggtgagtattctcaggacaaatgggaaaaagggttaaagaacccctaaataaatggagagaagtagcatgtttgtgattgagagactcagtgtcattaatataaagatgtcagttttgcgactgagcaattgatccaatgcaattactgtcaaaatcccaacaaaactatttttgttttgcttcat

SEQ ID NO: 14423 - DNA, 5144 bp, Human
attattagagccaaagagagagatagacagacccccatacaataataactggagacttcaacaccccactttcagcattggacagatcatccagacagaaaattaacaaacatcaaatttcatctgcaccataggccaaatggacctagtagatatttacagaacatttgatccaacagctgtagaatacacattcttctcctcagcacatggataattctcaaggatataccaaatgctaggtcacaaaacaaatcttaaaatttagaaaaaaagtgaaataatatcaaacgttttctctcaccacagactaagaaaaaaagaagtcccaaataaatacaatctgagataaaaaaggagacatgacaaccaataccacaaaaaattaaaggatcattagaagatactatgaaactatatgctaataaattggaaaacctgaacaaaatagataattcctagaaacatacaacatactggtctgttcaggttttgtattttttcatagtaccatgaagaaatacaagaattgtttctagaaccattcttgtatttcttcatggtttttgtatttcttcatggaaccatgaagaaatacaaaatgtgaacaggccaataacaagtaatgagacagaagccatactaaaaagtatcccagaaaagaactcaggatctgatggcttcactgatgaattttgccaaatatttaaaaaactaataccaatccaactcaaattattaaaaaaatagaggtggacagaatctttccaaatgtattctatgaggccagtgttttttctgattgaatctcccattatattttaatcacatataaaaccagagaaagacacattaaaaagaaagaaaactgtaggccaatatctctgatgaacattgatgcagaaatcctcaacaacaaattagcaaactgaattcaagaacacattaaaacaatcattcatcatgaccaagtggaatttgtcctagagattcaagtgtggttaggtatgtgcagatcaatgggtttaatgttgtccaatgaacataatgtcctccagctccatccatgttcttgcaaatgacaggatctcattcttttttatggctaagtagtactccattgtgtataagtgccatattttctttatccattcatctgttagacacctaagttgcttccaaatcttagctattgtgaatagtgctgcaataaacatgggagtgtaaatattttgttgacatactgatttcatttcctttggataaatacccagtagtgggattgctggatcatatgggggaaaatggagatggctaacgggcacaaaaatatagttagaaaaaatgaatatgatttagtattcgatagcacaataggatgactactgttaatgataatttattatatattataaaataactaaaatagtataaatgggatgtatgtagcagagagaaatgataaatgtttgaagcattggatactccattcaccctgctgtgattattatgaattgtctgcctatataaaaatatttcacttattccataaacacagacgcctcttatgtacccacaaaaatctattttcaaaaaagttgctctaagaatatagttatcaagttaagtaaaatgtcaatagccttttaatttaatttttaattgttttatcattctttgcaataataaaacattaactttatactttttaatttaatgtatagaatagagatatacataggatatgtaaatagatacacagtgtatatgtgattaaaatataatgggagattcaatcagaaaaaagtttctaaaaaggctctggggtaaaagaggaaggaaacaataatgaaaaaaatgtggtgagaaaaacagctgaaaacccatgtaaagagtgcataaagaaagcaaaaagagaagtagaaagtaacacaggggcatttggaaaatgtaaacgagtatgttccctatttaaggctaggcacaaagcaaggtcttcagagaacctggagcctaaggtttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattatgtcatgtgcacctttgcacagtggttaatgtaataaaatatgttctttgtatttggtaaatttattttgtgttgttcattgaacttttgctatggaaacttttgtacttgtttattctttaaaatgaaattccaagcctaattgtgcaacctgattacagaataactggtacacttcatttatccatcaatattatattcaagatataagtaaaaataaactttctgtaaaccaggttgtatgttgtactcaagataacaaggtgaacctaacaaatacaattctgctctcttgtgtatttgatttttgtatgaaaaaaactaaaaatggtaatcatacttaattatcagttatggtaaatggtatgaagagaagaaggaacaaccgatgatttctctctgcagaaggtagattgaggcatgtgaggaaataaaaataagacagagacattctctttaaattgactagtatacatctattagaaaatgtccattgccagttagatatataagtttgcaatttgcaaggaatgcgattgctgggggtttatatgtgataagagaaagccaagaaatgaaggtcatggtgttgggagagagtgtagagagagaaaaagttttaaacatgattctgaggacctttcgcttttaaagggaggggagagaaaagccgcaaaggaaacatccacagccacaaaggaatggctgtacattagaaggcaacagcagagaaagataatgaaagtgtatttaggaagataaatgcttcagcccaggagttcaaggctgcagtgagccatgatcacaatactgcactcgagcctgggagacagagggagagtgaccccatctcaaaataacaaacaaacaaaaggaaataaatgtgccgagaagaggattcagtcgatttgcccaaggtgtggcttgaaactgcctactaattgggaaatagatggcattggcacccttagtgagaactgattgggtaaagttaatacacagaagccatattggaggaagtttaaataagataagttagtgaactgaagtggagaaagaaataaaatgggattaggaaaggatgtgggttatgttttctgggcatagtttttccttttttgcaatgtatatttttctcaatagatttcatgtaattgaggtactggcaaatgacattaatatatttcatatatttattttaagtcacggcatatttaattacaatagtaatttatcagttttaattaatactactgtgactatcagtaagatgcctagttttgttaattatttaggcaggaatagataactaattcaatctttcatcaaaatattcaattaatattgataatataatggttactgcaattactggctttaattaagttacttaacttgcgccattgtcatgctagtttactacaacttgactgcatttctccggtagagccagatatgataagaaatcttttataatactccttggtaatttttccggattttatgaatattacaatcttacatgaatacaaaaataactaaattaccataaacatataaactgacaaacttccttcacaaattaaattaggaaactggatcagagaatctcttcctccatacttaagggaaagaaaaaaattagtcaaaccagctaaaaatacaacccgaaccatggaaattcagaaagtaccaaagagttgtgtataattcacgagtacaaggagatttagcaattgtaatagaaatccagaaaaccaaactgacaaaatcactcataatttgcattaaagactttaacgttgaaatttcattctgcttggatgtatgtgtggtgttgatcaacccacttattctcactgagcctcacttttctcataaaaattgggtttaaaatatttatgtagttgtgaatattagaaaaaacatgcattttaaagcacctaccactgtgtctcctatctagtaagaagttaaaatatgataggtatttccctattttcttcatacagctgtagatgaggataatatttatctttctataaaattcttaggacctgtgtcctgcatttcagtaagtgactgccaatggcagcagcctaaaaaaactagattctgtcagcaactgtagagtggttgaaaaacagtcactcctcatttcaaagaagtgtcctatttatatgcagtcggggaatggtggcttgtataaatacctgagacaggagaataaacatat

SEQ ID NO: 14424 - DNA, 4571 bp, Human
attgatgacttggggatcacaggggtactacccacaaaatgtagtgtaatttgttgtctgattgctgtaagctgtgtgaatcagggagagtttgagtttggacatttggctcgatattatgacaccaggctggttaatttatattataaaatgtagagggcaatttagacatgaggtcataatatagtttaatatagtgctacgcaaaggctgaaaattatgttgtgcttgcatttgaattcccagtgccgtatataccttaaaggaattagatatccagtgggtttggcaatacattctataatcattattgacacttagtaagagtagagtggaaatattagccattgtctgttataatcctaacaaatatggccatgatggaaacaaaatagcttggtcacccatgaatgccttctagtataaagagaaagtatgataaattgcttcagcaaaaactatttcttgaataagtacactaggcctggtactgaggataatgcagtcaacagaacagagtccagttactaaagagatgatttgccaaagatgattccatacttaccattttaagagagggaatctataggtctgaggcaacttaacttgctatgaaaaaaaaaaatcccagcgctcaggattggagttgtaagttaatgcttaacatgataatatttatccagttatgaatttaggacaaagatggtttctctttgtttaatagaattgacttggtttagaaactataaatatatgttgaggaatttgaactttaatgcaaaaatacaaaaaaaataaaattgatgatattttcaaagttgtgtatttctattggagatggtattgcccccaaggttgtagaaattagttcttgggggtgtgaacaactctcagatattacaatagtttgtggtcctccaaagctcaattcttacataatcttattctctagtgttcactttccttattgaattttcttgtgtatcgcacaagacatactgacattgaattcagtagaaacagacaaaatacatgcacaatcagtgttataaatctatggcgaatagatggcttactggaggactttctttccatcatttgctgtgattgcctttcttccagatgttgcttatgtttgagcttcagggattctgagtattaggtagactttgagaattaaatacaaatcatgtatatgttattatttaattctactaaatattttcaacacatcaacagttaatgtcaaatgctgaaaagaataaaatgctgacactctggatgaatatgtagcagctagtgaaattaaaaattagtttattttttaaagcaaaattaaaagttaagtacactaaaaatcaaacttaagaaaacaatttcattttttacctttaagaaacttatgcatgtcatcatgtttgtattattatgtatattactaatacattcttaatttgcaaatttgtttgagataatttatataaacaaatagagtgaattaaaagttgctgctcagagttaagttaaatgtcaaatttttaaaaatttaacttttagttaaattactttgccattcctaacagatcaagaaataataaaagtaaactttatgctttttcttttagtgtgcaaagtagacatacatacagtacataaggagatatacaatatatttgttattaaaatttaataaaaatttaatttcaattaagaaaaaaatttcttaaaagactctggaggcaggcaagagaagggagtgtcaataatgaccacatacacacacaaacacacacacaaaactggttgaaaaactactctatacccatgtagagagtaaataaatgaaagcaaaatcagacgtagaaagtaaattctgaaaatggaaactagtatgttccctatttaagacctacacataaagcaaggtcttcagagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaacctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgccattttaaagactcttgtttctgctataaccataccatgagttgaatcaaacgcgtcaagtattttcaagtgtgttaagcaacatcgtgttcagttgcacaggaactagtcccttacagatgactaagctgatggatctatttatctatttattaaatgtatatttatttgactataatatttaattttttgcccatataaatgcataaaatgtatacctttatattgttgataacataacaaaatatattttctatgtttagtcgatgtattattttgtttagtttattaaatatttactatagaaaacttcttggatttgtttattctctaaggagaaacaccaagccgattctccaacatgatttaaaaatgtatggttcaattcattgattcattgttattatactcaagttataagtacagtacaaatttacattctataagccagcttgtaagttgacttcaggttatagagatgaagatacaaatacacttcatgctgtcttttatctttctttgtgtagggaaaaaaacctaaaaacaagaataatcattaaatctgttagataaatgatataagaagaagaccaaaaaacagtattttttttcagcagagctggagtaaggcatatcaggaaacaaaaacaaaagcagcagatatcttctacagttgactggtagacacataagtgcaaatgtgcactggcaatttgatatttcagtctgcaattttcaagcaatgccgtgacctgaaactccaggaacagcagtggtcatgtgagaagtgtttacagaatgacaaaatgactgaaaatttcctcctgcaactttcaactttaaagggaggaaagagctacaatggaaacagatttggaatggccaaatattagaaggaaaagagagaatggtgataataataaatttaaaggactaaaactgcttagaagaattgatgcattcatgcaaaatatagagtagattgaaactgcctggtaatttgggcattggtgatcttagtggaagttgattggtagaatcaaccagttgactgatagacttaatcagtagaaaccatacaggagtaggtagaagagtaaataagagaagagaaggtaatggcaatatatagagaaaacaattttgagaagtttgccttcttgctgatggctgatgtgagacctagattcttgtcttgctagttttaagaatttaaacaagagacacacggcggtggagatgcagcatggagtaatttattgccaaaaaaaagaaaacgaatattttgaaatccaggtgcagaatagacagtacaccctgagacagacaggattcagggcaggctgctagtaaggatgagaaagtaaagactagtactagggagactccttttatgggaatcttccatgattatccataaggaggtgggaagaggcgttactagtaagcatgttcttggttgtcctctgggtgcacatgtgcagtaactgcatatgcttgttgtaacaccgtatgtctcattagcatcttaaatcttctacccacgggtttattctttactattataatgagcaaagggtcactctgaggacaggtaaaatcaaaatgtgcattctctctacaggggaactacagctttgcttgaatgagttcaattacaatgttaatgctaaagcttattgtggtgatggtatggtcaccaaggttgtgacatcctgatgatatggttacttccttgactacctatcctgcctcatcatgaaatgaaggagagaagtaaagtaggacctggaaaaggacatgaattaatttttatatgcatagctttccatttttggaaatatgtatgtctatagatagatttcatggatttgattattgaaaaatcatactagtataattaatatttattttaaattatgacatatcaaattat

SEQ ID NO: 14425 - DNA, 4571 bp, Human
tgagtgagatggtgctggggaaaataaaactaacaaattaacttaggattagaatctcctagcccaagtgaccagaaaagaatcaggattcttttatcacatttagatacacatttgttttctttctatctccattctgtaggatttttaaaatcacatttagatatacatttttctttttgtctccattcttaaggattcaaaaagagacaacctttactttcaatgaaaatgaaaatgagaaagaaagatctctggtatcctgcatgctatgtaaacaattgtacaacccattcatgctatcacatttacattacactatggacatttaggacaaaaatggttttcttcagtttgaggagaatcaactagaattggaacctctgtgggttctttggaaatctgacctttcatgacaaataatatttttaaaatcaaattgatgacatttttctccattgcatatactcattaagtataatattgcttccaagaatgtaaaagttatttcttggggccctctaaagttcaactctgtctgacaaaactttattccttagtatttttttaattgagttcttgttgttgttgtttgtttgtttgcttgctttttgaggcggagtctcgctctgttgccaggctggagtgcagtggggtggtctcggctcactgcaacctccgactccctggttcaagcaattctcctgcctcagcctcccgagtagctgggattacaggcacgtgccaccacgcccagctaatttttgtatttttagtagagacgggctttcaccatgttgtccaggagggtcttgatctcctgaccttgtaatccacccacctcagcctcccaaagtgctgggattacagatgtgagccaccgcgcctggcctaatttggttttcttgtaacatcagaagcattgaccttgagttcatggaagatacacaaaaggtatacaagatcagtgctacaagcatatggcaaatgggtggctgttattggaggactttccaagatttattagatgtcaaagtcatatcatgtgaggtggcctctgtatacatatgagctgtcatttgctgtcttgtgtatgttgcttatatttgatcctgagcatttatgactgtgttttgagttttgaggtttcaataaaaatactttatcttttactatttaattctactaaagttgttcaacacatcaataattatgtcaagcactgaagagaaaaagttttttgacaatatctagatcaatatctagaagctagtgaattttttaaatttccctatgaagcaaaattgaaagtaccctaaaaataaatgttacaaataatttcaattttaatagtctttagctattttgaatttttaaatatttcattatactaggcaatattatatattttcataatttgttaatttacttatttaatctgacacactacaatttatataagtaaataaatcacattgttacttaaacaaattgaactatgaagttaaatatccataaattgtaaatttaattattaacttttaccttagaattttcatttgctcattcttaatccgggactgaataaattctattttacattctattacgctgcttttaaagcattaaagaagtacaatattctctctcgataatgggtactgtaatgtatatacatcagccaacacatagtatatctgtgttattaaaatttaatgggatttttagttagaaaaaaaatttctaaaaagcatatgtggcagaggaagatgaggtaataatgtaaaaataaataaactgagaaacactcctgtacatctatgtagaaagagcataaaagaaagcaaaaagagaagtagaaagtaacacaaggcattcagaaaatggaaactcgtatgtgacctttttaagatctgtgcacaaaacaaggtcttcagagaagagcccaaggttcagggtcactcaatctcaacagcccagaagcatctgcaacctccccaatggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttcaaatattaatttctgctatatccatgacttgagttgaatcaaaattttcaaacgtttcacacgtgttaagcaacacttctttagctccacagggacaaaatctttacagatgatcatgccaatctatctattctatctatttatctatctgtctgtcttctatctaatctatttaaatatttatttatttataagatttaaattattttaaattatgtttgttcaggtaatattacatccacctttactttgtggctaatataataaaatatgttctttatgttttgtcaactgattattttgctttgttcattagatttttactattaattgtttgtttattctttaaaatgaaactccaagcctgattgtataacttgattaaaaacagatggtacagttcagttacctatcattattttattcaaattttaagtaaaggaagatttttcttaagtgaacataataaatacaattcctgttcccttgtatctttgatttttgccagaaatttaacaacaataattatgattaatatgagttatgttaaatgctataatgtgagctaggaaaaaaaacagtgaattgctctcagcagaacgcagatagaggcacgtccagaaagaaaaataaaagcagagctagcctctctaaactgacttttaaacatgtaattgcgaatgtgcattgctagtcagatacatgagtttgcaatatccaaggaatacaatgtctggaggatcataactggcaaccaaatgcctaaaaatggaggctgtcatgtgaggagccaatgtagagaagaaaataagacttaaactagattctgaggaccttccaccattaaagagagggaagaggagagacacaaaggaaacagaggtggaataccttaaacattagaaggacaagagggaatgatgataaaaatgtatttagaaaataaatgtacttagaagaagaatcaatagacttatgggaaatgtggattaaaactgcccagaacatcagaaaaatagatggcggtggagatcttggtgagagctggattggcagaattaatcagtacaaaccatactggagtaggtggaagagtgaatcagagaagagaaatcagtgataaccatatgtaggaaataattgtgacatgtttgccatggaaatggaggggggaaataaggttggacttgaaaaagaatgtgtactattttttatctacatagtttttcttttttgaaaatagagttcgtggattcaatctattggcaagtcatgttaatatgtttaatattttatgtatttaaatcataatattatttgcataataatttattattattttgattaatactatgttacatgtcaggaaaaaatgacaaacttccctcatgaaataaaatgggaaactggatgagagaatctctttatacttttggccaaaaccagctgaaaatacgtgaaccaaagagaaattcagagtgcggcagagagttgcatataactcagtagtaagaggagatgtaataattattacagaaatcctgaatacaaagcttatacctcaggtgtaaataaaaataaagaattttacattgaaattacattctgcttacatgtaagcgtgatgttcagaaaaccacttaatctctctgagcctcagttttcttttgaaaatatactttctacattaaaaaagcaatacatatcactgttattttcttttaaacttttattttaggttcaggggtagatgtgtaggtttgctatatagataaattacatgtcacagacatttggagtatgaattatttcatcacctaggttataagcatagtacacaataggtagtttatcaattctcattctcatcccaccctccaccttcaagtaggcccctgtgtctgttgctcctttttttgtgtccatata

SEQ ID NO: 14426 - DNA, 55226 bp, Human
  misc_feature (1)...(55226): n = A,T,C or G
aatattactgcctaccttttcaaagatactgcactaaagaaagcactgtcccacaggactgcccaagggttatccaagtctgggtagcaaggggtcgtctgattcaggcactaccctgagcggaaaacaatggcccaagacctcgaccaaacccagctctccacctgtttttgtacagctttgaactgagaatgcttttttacaatcttaagtggttgagaaaatatcaaaagtagaataatattttgtcacatgtaagtttacatgaaattcaaactttagaagaatttcctcttcacagacatcacatcttcaagagcaaatgcttgagccctaacctgcaagttatagtagaaaagtccagaagtccagcctggtcctcgccaagtttccaactcctatgcctaggggtattttatgcttacaggatctaacttggttacaacgtctaacttttagcagagaggcagtgctgagtagaaactggacttgttaaccatatcaagtcacttaagttggctaggatcccctacttaggtagcggccataaagcctagggcatccctgtgccctcaatggttcacttctgagtggtgggcttcctgctcctcaatagagcaatcggcagaaaggcccctagaaagctacattgtcttcatccgcgaaggattccctgtctcctattcctcaaaggagcacccggattctactttcattcttcttttgccattgcattttataacttaaaagaaatagatgattgtaacagaagaaagaaaactttacattgtgagaaaatttagacctaaagcttatagtaatgtgaggacgaaagtctatactgtttaagtaaataggttctatgagcagcatccaggctaacatcacacagtggtattttgaattaaattgtacttgtgttttgtttccgtgttttgctgctgtaaggaaagaggaaagcatcccctttctcggccctcctcccacgtccaggctaatttgcagcatttctacatctcagagtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccgccccgcgttagctgcctaagagaatctccgtggccggccagtacccgccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttaacttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattaagcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaagctcatctctgcaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaaacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccatgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctggatgcaagtcccaggttcactgaccctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagacttgcttgcttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctggtgcttttcccttccccacttcccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggtgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgcttcggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctatttcctggtagaaataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaatggctgtcaacgtccatgtgtttggaggtaatagtttaagaaaatgattataatatgattgctaaatagtagtggaatacaaaactccatattcaggatgatccagatgtataaagtattacagatgatactgtaaagtctgaattgggcactgagccttgggttaatctgttacttaaacagtataactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaacaagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgtttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaatttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgcttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccacacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatggagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggttttttttttttttttaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacgctatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccagcactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtaccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgtgagctaagccatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttca

SEQ ID NO: 14427 - DNA, 78918 bp, Human
  misc_feature (1)...(78918): n = A,T,C or G
ccctataggttaaatattcctgtgaattttatagatgaagaaacagagtaagtgaaagagttcatactcaattcaagtctcttgagtctaaaatcagtgctctctctacataagaagttagttgctaagatcacacaacttgagaagagagaagacagttttcacagtccctcccctctgaccactaggctgcttggggtacttttacaacttacctgctctgaattaaggctctctgtgaatctgattcatctgccaatttgcaaacagtcagccctgtagtacgtacctaagttgatttttaaaatactatttctcatcttaaaataatggaaattgagtgacataaatttcctggacactttttaagatccaaagacaatttgctaatttgtcgttacaattaaagagccccccaaaaggcgtaagaactggattttgacttggacttctgttccttagtttctttaacatattgggggccgggagtggtggctcacacctgtaatcccagcactttgggaggccgaggcgggcagatcacgaggtcaggagattgagaccatcctggctaacacagtgaaaccccgtctctacaaaaaatacaaaaaaaaaaaaaaaaaattagccgggtatggtggcgggcgcctgtagtcccagctactcaggaggctgaggtaggagaatggcatgaacccaggaggcagagcttgcagtgagccgagatcgcactacactgcactccagcctgggcgacagagcaagattccatctcaaaaaaaaaaagaaaaagatattgggaaaactcacttaaactctatgggcttctgtaccactaaggcttctcaaatttgatgcaagtaatgggaacttgctgtggctaacttgagccacaggagaaggatactgcaagactcacaaatgcttgaaagtttcggaacaggtttggaaatgggtaagaaccaaggaccgggttgacctgaactgaaaggaaattgaggtgctattagggacaaatatgaaatgaaggatgaactgtctctgacatcctttgcttctgtgtttggagatgagtaagcagggagtgggtgcatatgcaaacagggtggtcagaaatgctttggccggatgtgtgactgaaggctatgtgcagctgaggaaggctgggccaccacagtagcagagaggctgaccaatttggcatgcagcaagcaggaagtagaagggatcttaagcaagcaaagtgtttgggtagacaagattatgaggaatgagcaccaatgacatttccaacaagcactgaaagcttccaaatgcttctaacagttactgcctgtacaaacacaggacagtcttgactatgtgagactgtgacagtttcctcatgcctatgaaatgagagacagtacttagcactgacatgagcttcatatttgaaggcagcaaactactgaaccacatgtagcttccgaaatcaaaagatgcaaactggcagaccacaggtcagatatgacatgcagaaaaaaattagttactatcttagcctagtttgtgctgcttacagaatatcagagactgggtactttatagagaacacaaattatttttcatagttttagaggctgggaagtccaagatcaaagggccatcatctcgtgaaggcgtccctgctgtgtcaaaacatggtggaaggcatcacatgggcaaaagagagagagggaagcgggggcaaactcctttttatcaggcacccagtcctgtgattcattcatgaagacagtgtcctcctggcctaatcacctcttaaagctcccacctctcagcactgttgcactggaaattatatttctcacacatgaactttggggaacacattcaaaccattacagttaccaaagataaaaatgcagatttcagatttctcttggggaagaaaaaaggctctggcaataccagggctgtatttccacatggcaacagttgtctgttgccttctgttgggttgtgggctctcacattgccataccctcctcatggcccccttcactcataacagtacctgcctagacctcgaagcactagtttccaaccctgcttgagttaactacttccatgacaactgtgcaaggccagagtgtgggcagctaccttgagggccaccggcatgggctgcccaagtgaccgagggcactaacctctgctctcgaaacttctttggtaggatctcttcactcctgacttactacttgtaactgctggaaacaaccatttattctacccctactaaaccacatctgtcttttctgtcagagccaatcttcaagcatatgcttcctcaaaagactttaattaccaggtagtagaagcggcagcaaagagtccccatctagcatcttctaaaatgtagtggagaaaccaacgacaacgaatctgagacaaccagttgtttgacttctctgaaaacaacctctaaaaaaagccttctctcgtgaatagctgcagacatgctgggcactaattgatgatgatgccctttagtgagtctcctctgcacatacctgattccatttggatgctggccctcacatacttctatctgcgaactccggaacacagaatatcatacaatgtatgattcaatctggactctgctggagccattctctacaaagcagacacaactttttcttgcctaaatcctttcaagttgctttatttttatttttaaactaattaccataaatctaatttatcaagctgcttttaagataaactttaaaatgcttagagcagtctacaaattcttgcactgtttcactcttccttatctctcagtcttcatctcccattgcatcttctctgactctttcatatggatcttctttcaatttgtggaagaagccaagcttgttcctgcctcaggtccttgacacttgctgttcactctcctgggagactcttccccccatcttagcttttaaataccagctggtcagactccttacctgccttccaccttcctctcattctcccactcctcgccttcatttctcagagtcctccgctctcttctttctattgctcttaacacaatttgtctgttttccgctaatctgtaaactctacaagagcacttaactattttgcatcccaccgaatattcggagtcagcacagaccccgtcataatagagtaggtaagcaatgcttacctgtcaaatgaatgaatgaaacacccgattcatcccccaagccagcttaatacattagatgatcttatggactgaataagacatccctccttttaaagaatatttttgttttagcttcacatcagcaaaccccgaacggttcatcctaagataagcctggtagagaggaaagatactaaccttctagggtcctaaagtggaactaggaacttattagatatgcacattctcaggcattatttccgatagcccagtcagagaattctgggggtatggcccagcaatctgttttaacaaacctttcaggtaattctgatacacactaaagtttgaaaggtttctttaaggctttccagttttcttttcttttttggagggatgggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcaggatcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtaagggggcttacgggcgggggtggggaaactgaggcggaggaaggaagatggcgggggagggaggaggccgggaaatgaatggtgcggcgaggtgccgccgccggctgtcagtcctagacccgccggccagcgaggggtggggcccgcagccagggcctcgcgggtcccctcgtttctccctcctgggactggggcgggggcgcgggccccgagattcaacccccaaccctcccagcggctttctccgcgcgacccctcccggcccttcccccactacggtgggcagcgccgcccaaagggcgctggggacggtcgtcttgggggtggtccccgggcccgacccatccggctttcctttccctccgcgcccgtttttgccagtcggtttggggacccaggggccgagctcggggactggcctggcaggggagctagaaaagagaagcgctcctggtaggtttgacaagatcgctgtgacaacattctgcccagggtgtgggtggggaaagggaagaatcggactctgaaaatgggaacctacagtggggctttcatttgaccacccaccttctcctttcgactcctggtcatttccatctccctctgcgttttaaccggtgaaccaagtcacattttaattcgagggagaaagatgtcatgtgttacttctgtagcctcaaaaaagtcccccagtgagcaagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcatttctctgaaccaataattttttttatttctcccttcttagtctaattggtgagtatttttatgtctaggttcagttttaaaattagatttggcctgagtcagtaggataggacttttcaaatgtgttttgttaaagtgacgaatattgctacataattaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtgtatttttaagttattacattggtttctccaataaggagaggttattaactgcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagggagcttttacatttcaaaattctgtggtccccgaatgcaaattgtgcacctgtaatttgtctaattttttttatgctttagagaatgcattcagctctgaggtctctaaattacaattactcacttagtttaagtaaaaagttataacctgaatcaggttgctcatttcattcattatataaattaggggaaaggtggctgaaaaaaagtggccatctgtaaaacttgatcgtcttagataggaaagctgttaagagttaggaaacttgaaacttaagcccaaaacttttagggatcgtccagcaaaactcaacatatgaatcacctagattcaggtcataaaagagaatacttattttgaaaagaatttgaaaagaaatgcttcattcacattgatacccttatctacacacttttttggtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattcagcaattagtgcagataagaatgatcttgtttgaagagcagtggggaaaagctgggtaaatgaaggaaggtatatgtgggaagttcatgtttcttccatgaattctgtgcgtattgtttaataataatgctgtttctttttttttttttgagatggagttttgctctcatcgcccaggctggagtgcagtggcatgatcttggctcactgcaacctccttctgcctcctgggttcaggtgattttctgcctcagcctcccaagtagctgggattataggcgcccactaccacgcccagctaaattttgtatttttagtagagacagagtttcaccatgttggccaggctgttgttgaactcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccacccccctgccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccgtagaagatgaacgtttgacatggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagttatatttcgtgttattttatttacgggtagcaaaggctttgtagttatctgttgttgagttcaagctctatcacttaatagctatatgactttatacacttcaacctctgcaggtcttatttcttcccatctgtaatttggagatgatagtgtataccttataggttttttttgtttgtttttgagactgggtctctgttgcccaaactggagttcaatggcaagatcatggctcactgcatcctcaaactcctatgttcaagctgtcttcctgcctcagtcccccgagtagctgggactacaggcacatgccaccatgtgtggctacttttaaaaattttttgtagagatggggtctcactgtgttgcctcaggctggtctcaaacttctagcacaagtaatcctcttgccctgacctcttaaagtgttgagattacaggagtgagccaccatgcccagttttgttttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattccagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttaaaggacgattttgcagaattttaataataattttgtttcagaattttcaaaattctttccaaactgtcgatttaaactcaagccattcttacatactccttggaaccaggaaaggaatagcttgaatttgtgtggccagatgttatttttttttttttttttttttttttgaggcagagtgttgctctgtcacccaggctagagtgcagtggcgtgatcttggcttgctgaaacctccgtctccagggttcaagctattcttctgcctcagcctcccgagtagctggaattataggcacccgccacgatgcctggctaatttttgtgtttttagtagagaccgggtttcaccatattggccaggctgatattgaactcctgaactcaagtgatccacccgtctcggccagatgtattctttcagctttccttctgctccccaaccctaatacatacctgagaagaatattcatctgttcggatactcaacatgccatgttttcctcctgccgaaggacattacctaaacgttttatttttaaacattttgtccttgctttaagactttgtgtcatttgtgaaaatgcaatgctcttgggaagggtttctgtgcttttcagtatttagtgtaaaggagaggttacaatgaggaggataaaagtcctagagagagaattagggtgcagaagaccttgtagtttagggttggcttaatctactgtaaacatgtaaaccatgtttttagtattagtgtatgacaggacacaagtgtttgcctagttatagagattattttagttaaatctagtgtgcttctgctataagcatttttaaaattcagttactcaagggtacaaatatagcatttaatgtgtatttgtgaaacttgctttagtaaattaagggaaatgcctaatgactcacacagaattatagagctgaaaagggattttgagagataatttaatccagtcttcatttacaaatgaaacagaggctcagagttgagaaatgtcttttgggagtgttcctaattattaattgatagtattgttgagttctcttaaattttcttgtgagttcacatttatgagttaatagttgaaattaagtaattggaataacataatgtattttatttatagttaaagtagttttagttgaagcctacatcagaattcttcagtgtttcgttgtaatgcagaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgttattaccttttcagaagccctgtgaggtagttactgttataaataatcccatttcaaagataagtagtagatttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataaagggaagtcatgaaggagtttcaaagtatttgggggatgggtcagttaggaaattgccctgcctggaattcagatatttctgttgggagctgtgggacagcaagtagtttatttactcatcttgccttatttcagaaggattttaaatggggcagaatggtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttatctttatagctaatattgtcttactctacttgacaaatttccctgtgaatcagccactgcattcttgttttaaaagtttctggctgggcacggtggctcatgcctgtaatcccagcactttgggaggccgaggccgcagatcacctgaggtcgggagtttgagaccagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaattgtaatggaacattggcttcaaagtcaccactatattagcccctagcaagagagtgtaattgtacatgttttaatgtacaagcatttgcaatttgtaaaattaaaaataatatccaaggcaaaggatgttaatgcttttacaatgcaggcataagttgttttactactgaaaaagattctattaatggatttcttttaggtaggtacaatcaataatataacagatacctgcatttgttagaattatgacccgtgaacatttaattatacttactttatctttcttgttttaaggaacaaaagagcattattgatgactgtccccaaatccacttcccctttcctcagaggcagttactgttgtgacagactcgccttttttttggtataaaactcatctttcttttgctgttgatttctgccagtccagcctcctctctcacctagccttcttatatttctactattattcttctagtcaccaaggctttgatagcttcaaaagtgcttttgaattcttttctctatattcctttctctaagcaagttgtttttctttttttttttatgtaaaatgatgtattatatattttatacaagcaaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaacagctctccaattcctccatttcccaatacctggcaactgccgtgctacttatttatcaggttctattttagatccccatatatgagtacattgttttccttatctttgattttcagtggtttgtgcctaagtgtggttttctttatatttattctgcttgggtgttcttgagcctcttaaatctctaaatttctgtctttcactaaattgggaaaatttttagctactattcctttttatttgtttgtttctgagactgagtcttgctctgttgcccaggctggagtgcagtggcgcagccttggcccactgcaacctctgtctcccaggttcagcaattcttgtgcctcagcttcctgagtagctgggattacaggcttacaccaccatgctctgctaattgtctttttttttttttttttgagacggagtctcgctccgttgctgggctagagtgcagtagcgcgatctcggctcactgaaacctctgcctcctgggttaaagcaattctcctgcctcagcctcccataatttatttttagtagagatggagtctcgccgtgtgggccatgctggtcttgaactcctggcctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcatgccattctcccgcctcagcctcctgagtagctgggaccacaggtgcctggcactgcgcccggctaattttattattgtgtttttagtagagacggggtttctccttgttagccaggatggtctcgatctcctgacctcgtgatccgcccacctcggcctcccagagtgctgggattacaggtgtgagccactgcacctggccacgtgtatcacctttttgatattgtccttgatgagtccctgaagctctttcctttttccttgttttctttccccccaatttcagaatgaataatttctactgcttggcctttattttcatttatctggtgatatttcctttattatcaattacaggtctatgttaatactcattgttgattggaagtctttatcttataattccagcatttgggtcatgttagaattgccttctgttgagtgtcttctcccaggagaatgggttatgttttcctggttcttcctatgtgaagtaattttggtttgtatgaatataacactcttgtttattcgttctcttgttaaacatttgtttttcttccagttttgggtctttatgaactattctgttgtgaacatacatgtacacaattgtgtggacaactgtttttatttttcttgtttctagtagattctaactagaggtagaattcctgggtcagatggtaagtgatagttaaattgttttcgtaagtggctgcatcattttgcattctaactagtaatgttttttattttgttgttgttgttatacaaccctccctccaactagtaatgtttgaaagcacctcagtgcacttttaatttgcattttaaaaatcccatggagttgagtctcttttcatttaataaccatttctgttgttctgggaatggttagtgtctttttgcctttccttcttttgtttcctcccttcctgtccttccctcccttgtcattaacatctaggtaccctttatatgttaaagagattatatctgtctagataatttgtgtagataatttttctctgttactcatttttcttttggctactttgggtgtgtttttgtaaagaagtttttaatttttacatagttgaaataaccttttatagtgtatgggttttaagttatagttagaaagtctcctgcactccagggttataaactatatcacattttcttttaaactttatatttgatacatttagatttatcctgctttaacatgtgcggtaggtatccagtattattttcttggtggtaactgctgaggctggcaggtcacgaggtcaggagttcaaggccagcctggccaacatggtgaaaccctgtctctactaaaaatacaaaaattagctgggcatggtggtggatgcctgtagtcttagctacttgggaggctgaggcaggagaatcgcttgaacccaggaggcagaggttgcagtgagccgagatggcgccacgggactccagcctaggcgacagaacaagactccgtctcaaaaaaaaaaaaaaattttttttttgtggtataatactcataaagtttactgtttaactatttctaagtgtgcagtttagtggcataaagtacattcacattattgtctaaccatcaccatcctccatgatccataacttttttatcttcccaaactgaaactctgcgcattaagcagtaacttcccgttctctcctcacatgcgaagtcccaggcaaataccattccactttctgtctttatgaatttgacttttctaggtaccttctataagtggaattgtacaatagttgtccttttgtgattggtttattttacttataatgtattcaaggttcatccatgttgtaagcatgtatcatgtgtttcctttttgaggctgaataatattccattggaagtatatatcatattttgtttatccattcacatgttgatggatgcttgggttgcttccaccttttagctattgcagatattgctgctatgaacatgcatgtataagtacctgttcaagttcctgctttcagttcttttgggtatatacccagaagtggaattgttgggtcgtgtaattactgtatttaatttttggaggaactattttatagttttccacagcattgcaccattttaaactctcaccagcattgcacaagggtttcagtttctttacatcttccccaacatttgttattttcttgataatagccatcctaatgggtgtaatggggtatttcattctggttttgatttgcattttctttattattagtaaggttgaacatcttttcttgtgtttattggccatttgtatattttctttggagaaatgtcattacaggttgattgctgatttttcagttgggctttttttgattgttgtgttgttctttattctggatattaatcccttacagatagtgatttgcaaatattttctcccattctgtggattgcctttccactgttgatagtgtcctttgatacacaagtttttaattttgatgaagtttttctctttttttcttttgttacttgtgcttttggtgtcatagccaagagatcatagccaaatttagtatcatgaagcttttcaccttatgttttttttctaagagttctatagttttagctcttgtgtttaggtctgtgatcaactttgagttaacttttgtgtatggtgtaaggtaaaggtacaacttcattcttttgcatgtggatatccagttttccagcaccatttgttcaaaagactgtcctttcttcatcttagtagttatggcatccttgttaaaaatcatttaattatatatgtgagagtttatttctgggctcctgattctgttagttcttatgccagtaccatactgttttggtcactatagctttgtagtaacttttaaaatgaggaagtgtgagatctccaactttgttctttttcaggattattttggctattcaggatcctttgagatccatatgaatgttaggatggatttttctatttctgcaaaaatgttattaggattttgatgggaaatgcttgaatctgtggatcgatttgggtaaatagctttcagatatgaaagtttgtcccaagtctgaattctgtactaaatgcaattatccagatggcaaatttaagaaaaaatgaagccatttaaacttatttttaaagcttattaggagggaatgagatcaggttgtttactagctgtccaaaagagagtttttgctaaatgtaacttagagcaggggagaaggtgcttttatgaattacttttttgtttattttttattgtaattttataataattttttaaagacggggtcttgctctgttgcccaactgaagtgcagtggggcagtcatagctcctccatggctcaagtcatcctccctgcctcccaagtagctaggactacaggtgtgagctgctatgtccagctgatttttaaattttttgtagagatttggatcttgatttgttgcccaggctggtgttcacctcttgtcctcaagtgaccttcctgctttggcctcccaaagtgctgggactacaggcgtgagccgtcacacccagctcatgaatgacctttttgaatatccaggaaatctttacagaaaattgcaagggctgtagaaaaataaattatactgataggatttataaattcaaagcaaaaatttattttggaaaagtaaggttaaaagtgggttgttggccacgcacggtggctcacagctgtaatcccagcactttgagaggctgaggctggctgatcacctgagatcaggagttggagaccagcctgaccaacatggagaaaccctgtctctactgaaaatacaaaattggccaggcatggtggcgcatgcctgtaatcccagctacttgggaggctaaggcaggaaaatcgcttcaacccaggaggtgcagaggttgtggtgagccgagatctcgccattgcactccagcctgggcaacaagagcaaaactctgtccccaaaaaaaaaaaaaaaaaaaaaaaaaagtgggttgctgtgatacacttggtcaggatcctgaagaacatcattattctttagagagcaacaaacatgtatatatgcttagagaaatgcttaataggaaagtcatttgaaacctatttgtattattacaaaaatatttgaactttgtgtcactgaaaaacaagagccttgaatttaaagatagtgattacatccttaaattacaatttaaaaagttcatatgtcaaatgccaattagctgttagcagtttttttttttttttgtcaaagaaaaagcgagagaaacttctaccatctacttgtacaaaatttcttctttatggtgactatcgaatttttagagttcataaaaatatcttaaggataatatgtagttatttcatgtgtaaaactcaatagaattggtaggttaatggaggctagtttacatttgaaaagcttttattttggagttttaaataaatttaatatttaatatactttctaatttttttctttttctaataacaattttcaaacctcttcctctccttaaatgtttctcatctcacatataagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattcagcactttactccctgcgggagaaaatgtgactttttgaaggttgagccttcaaaaccttttttaaagtttagtagataactttacttttttagattgtgtcctgtaccacattttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttcttttgggatatttaaaatttaaatctaaggtagtagaacattagttactgctccccaaaatgtagtagattattttgctgtggcatttaaaatacattagaagtgattaaataaattatggtatatccatacaattggatactgtatgcatttattcttgtgttttgagaagagcatttttgttttgattacatattgactgttttgtattaggttcatttgatccttttggtgtttattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttacacacataaaaatatgtgtggcttatggttgaaatgaagattagtcaaaagaaaggatgcctgatagttaaaatgatcaggaaagacttcctggagaagttttaagttgtgataaaagtttttttgttgttgttgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagccagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctggtcacttgaaagaccaaggcatgattagtgagttgggacttccagccccaccctccaaccactggggctgaaggttaagttgatcaccagtggccaatggtttaatcaatcctgtctatgcactgaagcctctataaaaacccaaaggacagagtttggagagctttcagatagctgaacacgtggaggttctgggagggtggtacgctcgagagggtgtggaacgtctacgtctcttcctacacacctcaccctgtgtgtgtctttatctgtatgctttgcagtattatttataataaaccagctaatgtgtttctctgagttttgtgagccactttagcaaattaattgaactcaaggagggagtatgggaaactcatcttcaagcaggtgagtcagaagttccagagtctggggcttgtgactggtgtctgaagaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcattgtttttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttatttggcacacttttttttttttttttttgagacgaagtcttgctttatcacccaggctggaatacagtggcatgatattgcctcactgcaacctctgtctcacaggttcaggcaattctcctgcctcactctcctgagtagctgggattacaggcgcccaccaccacaccctgctaatttttgtattttaatagagatggggtttcaccatgttggtcaggctggtctcgaattcctcacctcaagtgatcctctctcctcggccttggcacactcagttcttgaacttaatttggaggctaaaacattccccaaagatattgtttatttatttgtttattttttgagacagagtctcactctgtctcccaggctggagtgcagtggtgtgatctcggctcactgcaacctccgcctcctaagttcaagcgattctcttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcagcttcccaaagtgctagtgttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatccttatttatgttgttattttgttagaagaatgtaggccaagtctactgtgacaaaacattaaatcttatatttatttttgaatagtaattaatttgaatggtatgaaacaatgtacaatgaaaacaaatctccttctcatttctgttcatcatgccccagttcccttttttggagacaaccaaaattattcttgtgtagtcttccagagatacgttgtgcctatacaaaatatttcatatgtttttactcctccccattagttttatacagatataccatacttgatacattgttctgtatctttgttcaataagtaatatattttgggaattgtttcctatcactatactaagagcttcctcattctattttttgtagctgcataatattccatagtataaacttagcatatttcaatagtttccagtttgattgatatttaggttatttccagtcttttgctgttagaagcaagattgtagctaatgaccttgattgtgtattatttcacatatattcctgaaggatcaatttcttgaagtggaatttcttttcagaagctctgtgcatttataattttgatagaattgtgaaagtaggggttaaatgaagtgaaactatggaatttggtatattatttacctacgatggaatctcacttcataacaaatgaaattctaagaaagaaatgtataattgctaaaatattagtgaaatctttataaattattttgttttgcaggtatacaaaactaggatatgctggaaatacagaaccacagtttatcatcccttcctgtaagtatttcttttaagccacaaatgagctgatttaaaagatccccttccctaataatttaagtaaaagaagtaatcagttctgaaatcctaaaagatttagtccttttaaaaacatgatttgccaggttctaagtgtggcctcatttttgtatgtctgactattcatttcagctttatgtttagctccccatttgccatgtctactaaatacctctttttaaagaaaaaaagaaattagctgataatgaaacagtaccccaatttttagggtgatattgcagttaacagtatgggggtataactaattatcaagtagtccattccccatcatatacctatgaagactgtcctttggtttgtggatatgactactgtttgtagggcccgtatctgttgacgtcctcactaagtgcccatgtttcaaaatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctatttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtgatacatgttggctttattgctgactaatgtagaggtacttctttgggctagtacttgactttagtcgtatttcagtttagtgttagaccatcgtgtatgtacttactggtttctttaagctaccgtacgtaacacagtaccaaaaattgggtggctgaaaacaacaaacacttagaattctggagtccagaagtacaaaatcaatgcgtcagcagggtcatgctcttgctggtgtcttctggcttctgatgtttcctcaggatccttggctgatagatgcgtcactccagtcacatggctgtcttcttgctgtgcgtctttacatcatcatccttctgtatctgtgttcaaattttccctttctatgaggacactagtcatattgtattaggggccaccttgataacttcgttttaactgtgaagaccctatttccaaacacagttacattctgaggtactggcggttaggacttcatatctttttggtgatacacaattcaacctgtaacaatgctgatgacttttaatcttttgtgtataatcttttgttgtgattgtatatttcaggagactactaaagttatttctgccatcttagcaaaattggttttggttatattcgtaaatggctgtgttaactttttgttggaggcctatataatcttgattttttgaaccattggatctcatcactattgaatccattttttatcttatctctctgccaaaatatgaagtctttgccatgactagttgcagtatgttaaaaattcatttgcctgctgtaagaaggtttttgatttttgagtgttttttctcacccacccagttttaatgctgcaggtacagtgtttataattagcagatagagacattgccactgtcttttactaatgagtattgatatttgatctggaaagcctgtgcaagtggttcaaggttttttttatatacatgcatatttatttttaggaaatttatagtgagccacctggatgtctatgtacactgtaagtaaattgctggagagaatttctagcatttagaaggactagatggtggattaaaaatttttttcttccagttattttctgcccactttcttaaggatatagctgttactaaatgaaagtaacagttgaatgccagatcagtttaagtgcattcagacaattattttgaatgaagaactgaacttgatggattcgtacatttataacttaatctaaaaatacataacaagttttagctttcaaactgtatgctggatttctgcaattatttaaggatattgttgtgggtttcacctaaatgaattgagatttccttttatatatgtagtttaacagatctgtattacatttaaattactagaccacaatagtaattactgttactagacccaatcactattactagacccagtagtgatagggtagagatgtaaagaaagtttaaaaaattattcttgaagtttttttctcatttgtgtttttcagtttttttctttccagttgttcatcaagcatatgtggatttggtgggattacagttttactgagaatcaaaggaggatttatataatttaaaaaatatatatttgaaactttcccacagatgttgtttttctggctttttgcatttgaggtcttgtctctgagtggaagttgaggtttcgttgtgtgaaatgaattttgtcactggtttcttatgacttttgtgaattagtttgacaatttaaataggctaggtcatgttttactttgtagtactttgtaatgggagaagtgtaaggtaaaagtttttctcatttgaggaaaatgaattctttgacatgtctaacttattttaaaggtattgctattaaggagtcagcaaaagtgggtgatcaagctcaaaggagggtgatgaaaggtgttgatgacctagacttcttcattggtgatgaagcaatagaaaaacctacatatgcaacaaaggtatgtttttatgatttgtataaataacattttcaaaaaatagtttgttcgatgcttgtgccctctggaattcactctataatagaccttattaatatcctcaaacctcttctcagtagaaatttctttttccctatggcatccttccctgttgctttaacttttttttttcttttttttaataacccctaagaggaaagttttagccctttcaaatgagcagtatttatttttccacacccactggatctcagggccctcaataaaattacctttacttccacattgctacttctgcaaactttttttccccatctttattcaaacttacaccatttttctcttttttgaagtttatgccatctgtaagtgctgttctctttctccctctttttctttttccctttttcttttctacccttttccctccctcttttaattgaggtgtaagtatgtaagtgttaattatacagttcgaagaatttttatgactgtaatcataacaggtaaagaaacagaacaaatctagtaaccctgaagctttccttgtgcttgttcacacagtcactactccattcccaccaaaaaataaatgctattctgacctttatcatcttattttttgacactgactttgtctgatttgcaaatatcctcctttgtacttcttcccttctcataatttattcattaatgaacaactaccatgtgtaaaatactttgccatgtatcgtgagtaaaatggtgtataaaaaaatttccccgactgcaaggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctgaggtgggcaggctgagttgttttaggtagagaaaccaatatatgaaaaggctttacagtatgagagggactagaagtgcatgaccaatatgcctgaagcatggagaacgaggtggaaagaagtgaggaggctgtataggtaggcaggaaagagcactgaatatgttgttagaccatgttaaagaatttgaaccctatcctattggcaacattaatgagtatacctagaggaataatttttgcacttaaagtgcaaatattggaatctgcctgtttgaacttgaatcctgtctgtgctaatttctaactttgtgatatcattcagtgacttaacctttctgaattttgatttcttcgtctgtaaaatggagatattattagtacttgaagatttttttcttttctttctttttttttttttttaagacaaagcctcactttgttacccaggatggagttcagtggcatgaacatgactcactgcagccttgaatatcccaggctcaagtgatcctcctacctcagcctcccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagtaaattgtacatactatttcacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgtcttgtaaaatttcctatattctagggattctgattattacatactcattgggtcatttaacatggtaccctacttcctatatttacttttttttgttgtaaatggtagttaaatgtaagtctgattagatttatgggaggtttttgtttgtttgttttgacaaggaaaaagtggataattaaagagtaacagggcgtgatgaatgggatattggtgataagctagatgtatcaattgagggtaattcccagctccgagatagtcttatttatcccttatctgctgaaattgagaatgttaaaggaaaaacatctaaaaattattttattttatttttaagacaaggtctcaactttgtcacctaggttgcagtgcagtggcacaatcacagctcactcactgcagcctcaaacttctggactcaagagattttcacacttcagtctcctgagtagctggaaccacaggcgtgtgccaccatgcttcgctaatttattttatttttatttttatttttgagatggaatcttgctctgtctcccaggctggagtgcagtggcgtgatctcacctcactgcatcctccacctcctgggttcaggcgattctcctgcttcagcctcctgagtagctgggattacaggcatgtgccaccacgccggactaatttttgtgtttttagtagagatggggtttcaccatttggccagcctggccttgaactcctgacttcaggtgatctgcccaccttggcctcccaaagtgctgggattacaggtgtgagccactgcgtccggccttttattttattttttatagagacagggtctccttctgttgcccatgctcgtctcaaactcctgggctcaagtgaccctcccatgttggcctctctcaaagtgtgggattacaggcatgagccactgtgccaggcttttaaaaaaattttacttgacatataataattgtacatatttatggagtatgtagtgatattttgatatgtacagtgtgtggtgatcaagtcaatgtaagtagcatattcacctcaaacacttatttttttgtgttgagaatattcagaattctctgttctaactatctgaaaatatataataaattaactgtagtcatcatatagtgctatagaacactagaacttattcttgctatccagctgtaattttgtatcctttattcaagctctccctattcccttctttcccctaccctttccagcctctagtaaccacttttctactctctacttacatgaagtcaatttttttagcttttgcacatgaatgagaacatgcaattttttatcttttagtccctggcttatttcacttaatgtcctttgggctcatctgtgttgccaggaatgacaggatttcactctttttttatggttgaatagtattgtgcatatatactacacatatccgtatggacacttaggttaatttcatattttggctattgtgaagagtactgcaataaacatgagggtgcaggtatctttgatatagtaatttattttcctttgggtatatacccaatagtaggatggctggatcatatggtagttctatttgtggttttttgaggagcctctgtactatgctttatagtggctttacctattaacattccctccacagtatatatgagttcccttttctgcacatccttgccagcatttgtgattttttttgtcttttgggtaatagccattctaactatggtgagacggtatttctttctggttttgatttgcattttcctgatgattagtcatgttggacgtttttttcatgtatttgttggccgttgatgtgacttcttttgagaaatgtctatttagattatttgcccttttaaaaaaatcagtgtttttttttttttttcttgctgttgaattgaattccttatatattctggatgttaatcctctgtcagatgtacagtttgcgggcattttgacccattccataacttgtattttccctctgttgatggttttcctcacagaagcattttaatttaatataatcccatttgtctatttttgcttttgttgcctgtgcttctgaggtcttatttgtaaaatcttttcccgtaccaatgttgtgagaggtttcccctaagttttcttctagtacttttatagttttgggtcttagatttaaatctttaattcattttgagttgatttttgtataaggtgagagctagaggtcttgtttcataaggagaaacacttttgactgggtagtgtagagaggagaaaataagtttaattttgaacacattgtgtttgaggtacttgtgagacgtctgagattttgttagagtcaaatatgtggattttggaggtaagaaacaaggcagagctggagacagagattcagaaagtgtcagttaccttagacgggttgacattacctaggggaacatatcacaggggaagagaactaagacagagcagtgtgccagttaggtttgagtagaggaggaaaagtctgcgaaagagactgagaatgcatgggtagatatgtagaggtaaacactgtagaatggtgctgagatgagctagagcccatagataatttgctgtctttcgctacaaggtggtgatttgtaacctgaatgagaatagttttagaagagtagttgggctagatgaaagtaggcttttgagtgataggccaggaaaaaagtaacagtaagagtactgttcattgagtttcaattgtgattgggagggagagagagatgaagagacacatttcaacgttaagatggaagacatgtctgaatgctaatatgaaagaactattagagattaaagtaacaggaaagataaggtataatcaaggtctctgaaaaagctggagggatgagatccagaacacagatgactgaattgacatgcggaatatcttacattataatggaagtaaatgagaaaaaaggctaagtatggaatccattttacagatttgaattcctgactgttggcttctgctgcttctgcgaaatatgtggtggcatcatctgctggtcatggatgtggggagaaggtgaaatcttagcggtaggggcggcattgacactcgtcattgtgaagagtaaagaggaacagagtagaagagtaaaggcttgccaggcaaggttaggtccatttgagaataatgactatgaattcttagtctttagcaccctagtgcaaatgcttctgcggtataatcagcattctggatataggcaagtttatgttagggatatatgctgggttggattttggtagacaggatgaaaaaagaacatgtgaaataaaggtgatgggtcaaaatctagactgtgtatattgatggctagggaataattaaagcaaccagtggaccaaaagtcttaattggtgttcagaagagatctcttgaggtggttgagtatgctagaataataagaggttgtgatcagagaagggtatacctgcatttcagcgattgagaggtgatagtgatgatgatataagatctatactgtggccaaaatggaaaagagataccactgaaagtgatgaagtcagtcagtcgagaggccagagttcctttccactgattctgtccactcattttaaacgcatttttaagtcttctaagtgctactaacaaaccagaacaaaacttctctcaatctttattcctaccttctgtcctcagcaatttagctatttttctctttccttttaaaacgacacttcttagtgagtctcaagatatttgatatgctctttgttaaatccaattatatgtaacagttttcatccttcttgatttgtctttcttttgcaggattactctaatggttatcttcctaacatggaatatttgtttgtttgtttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctggtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagcggggactacaggtgtgtgccaccacacctggctaattaaaaattttttttttttttgtagagacagggtctcactacgttgcctaggctggtctcaaactcctgggctcaagccatcctctcaccttggcctcccaaagtgctgggattataggtatgagccaccatgcccagccctttcttattcttattgactgagaaatcttcaatgtggccccttgtcgtccataccactattggtactcttgttctcacttggttctgttaagcttcatttgagctttcccaatgctgctataatagtcttcctaaaaattaaagctgttcttattcccctgcttaaaaatttctctgctgttttatttcttatagaataaaacctaaataaaaggaaaatttttgagaatctagtccctttgatctagaactggtatatctctctacgcaccttcaaatcttttggcacataaatttctcattgataacttcagttttgtttttgtataccatgcagtgtttgtctttctatacatctttttctgttctccacaagttcctccatacctctcattcccctgccaaaaaaaaagccagaaagcagaactgagttaagacccggcttagatatgacctcctcagcgaaaccttttctctcacaaaacaaggtggtcatcttattcaaggaactatttatttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgacctcaaatgatccacccacctcaacctcccaaagtgctgggattacaggcgtgagccatcgtgccaccttttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccgttagggtctcagtaacgtttttcactgtgccacctagatcgaaagaaatgtctgatagttctgtttattaaatacctaggtccaggcaacttagtagccacttgaaaaaaataagacacttaaattggaaacgttatttcactgctgagtaatcacatttctgttaggatgcttaggcatcgctcagcttctcaaacctggaatcagatgggacattgccaccctgatttcttgttttatatcgatgttattttatgtgataacttggtttttatgccagcaactgctgacaaaccaacttctgtaagaaataatgtcattgaaaggaatatataatagtttgatttattgttgaaactgaattactgtgacttgtagatcacgcagtgtccaactgatgttgagtaacactatatttccctggaaaatttaaaataactttgcggcgcccttgtgaatttatggtagtacactggggtgctgtctcagttcattttctgttgctataatgaatacttgagactgagtaatttataaagaaaagaggtttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgagttttggtgggaacacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactagtacaatggtcttccatgtagatttaacagtttttaacattttgacatattcactttgtttttattgaaccatccatctgacaatgcgttattgaactaatttatctttaaatccttaagtacacatcttttaaggatgttctatagtatcacacctatgaatatatcctcatctaatatccactaatgatctgatatttccttttttgtatttttatttgttttttatattaataagatttaatttgtatttccctttttgttttaatagtggccaatccgccatggtatagttgaagattgggacttaatggaaaggtttatggagcaagtgatctttaaatatttaagggcagaacctgaagaccattattttcttttggtaagttacaagttataatttcactgaggaaatttttgaatacacttaatgagaacattttcatcatacttctttggtatactttggttattaaattgtcatatgtctaaatgactttgtaataaagctgtatcatctttaagaccatctagttatggctacaggagaatagtagtatgtcaaagcaccacatgttaaacacttaagaagtgcttttggtagttaatgtctaatctttatgatagaaacagtaagtaatgttcagaaaaatgttggaaacctgtggcacttttttgcttaaaaaacaatagtctgattattatatcattggtatttcttcataacaaaaatacaatataatctaactttttattaaacatctttttattaaagcagtgcatgttcataacttaaaaaatcaaatgactttataagatttaaaacaacaaaataacactttcctttcttacctctcccaacctttggttcatattccccggaggcaaacattttcaattttaacaaagtttgccctgctagtaatcttttaacatgtttcttttatttaacattttttttttatttcttctgtctttaagaatattatacattatttaccaacttcctaataggaaaaatgagaatttccctttttaccttttctctccctcaacacaaaatacctatcctttcccactcctcgcattgtagttacatcacaatttttggttaaatcaatattctgtgtctttcggtgattgtgatggactataaagttgaaagaaccatactatggacactcatacacccacaatctagattcgatgattaaccttaacatttggctataattgcttcatgacgtctatccatctttcacttcattttagtttttaaatcacttcaaagtgagttgcaaatgggagtcatttgacccctaaatactttagcacgtatttcatcaactagagctatcatttgtgtatggttattcttttcatataaaatttacatatcataaaatcaccggtctgcaccattcagtggattttgaccagggtttggcaaactttctaagggagcagatagcaaatatttttggctttgcaggggttatagtccctgaggaaacttaatgagaactttttatacaatggtccctgtcacagctactcagctgtgctgttgtagcatgttagcagccatagacaatacttaaattcataggtatgtctgtgttccaataaatttttttttttaccaaaacaggtggtgggctgtatttgacctgcaggatgcatgatgtgatttgtccaatctttgtcagttacatacatctgtgtaacctaaactcttaccaagatatagagaaattactatcagcgtggaaagttttctcatgcccttttgtaattaatctctgcccccgtgccctagtgacaaccactgtttctttttcatctgagattagctttgcccatgtttgagtgtcaaataatggaatcatgcaatatgtgcattttggtgaaacacttttacttagcataatctggagattgaattatgttgcatatactggtgatttgttgctttttgttgctgggtagtattccattgtataaatttgcctcactttatccattttcctgttgatgaatacctgggctatttttgtttttttttttgtttttgtttttgtttttttaagacagggttttgctctgttgctcaggctggaatgcagtggatcaatcatggctcattgcagtgttgacctcccagctcaaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgcagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctggctaacttttgtaattttagtagagacaggattttgccatgttggccaggctggtcttgaacttctagtctcaagtaatctgcccacctcggcctcccaaagtgctgggattatagatgtgagccactgcgctgctagcttgtcagtctttaaaattttagccattctggtgggtgtgtacgatttttcatttgcttttaattttaattttcattttctgataattatgttgagcagtctttcatgtacgattgttattattagctatttgtatattttcctttgtggggtcctctgattatcttttatgtagattttttttcttggagtttataatttcactgccttggtttttagtttacttaattttgtatgtattcatcagtaaattatctccagacttttaaacatagctccagaactcttctaaagaagtttaaacaccacagggagtttagcttataaaggttttatgtaaggtaacagtatacttagttgttttgctttatatttcttttgaaataataattttaaaaatatttaatttttaatggattcaagttttatcactttttccctttgtgatttgtacttcagaaatttaaggagttattcctaccttaaggtcaaaaagagaattctgtgtcttttttaaatttaaaaatttttcttttacatttaagtatttgagatacctattagattgccagtcagactcacaagaatcagaggtcttacccagtgttaatctttaaaaattgaaacagtttaagtgatcatgaggcataggtgaaatatgaagtccaagactgccagatctctgagtccttccttgcctctttagagtgtgttctgtcccagacttaacctgtgaggtttctaagtgatgtatacagtcacataaacagaagagtgctctgcaaacatcttgattctatgctcttaacaggtaaattaatataacatttttcagaaagctgtaccattagatctgtagaatctcggcttgtttactgtaatcctatatacttcggggacattcatctaaaagcattacttagatgagggctctcccactggcaaataccattgatgttttttctggaggtttgtcattaccatatttaaaggatgatttgactggaccaccttttccctacctccaaccctctctctccctgcttcatttctttttaatgtttaatctgtataagtggtatgatataggcattcagggtattttttttttaaaatgtgaattaccatactgttttcatatatgtatggatgtttgaattctctatagttttcctttgatctctgtgtctgtctttctacttgtaaatttaatgcattttaaataaaatgtttgaaataaattacttctcatttaaaaattgtcaagaaagttatcaaaataatctgatattatctatttaaaatgttatttatttcaatagactgaacctccattgaatactccagaaaacagggaatatactgctgaaataatgtttgagtccttcaatgttccaggcttgtacattgctgtgcaggtaagcaagttcatactttctaagtttgattcttacattttaacctagtttaatttgctgcctaaaatacgtactttttttttttttctgcaaaggtttaaacataatgtcaaagcatgttatacttctctcctgaattgttaatttagaagtaatattatgggaagtggagatatttagtcaggaaaagagaagtgttaaaaaagtaagttagtggtgtttgggtatttcaagggctttcataggacagaaatgaaggaactaatatttatggaatgctttctctgtgacaagaacattgtatatatatttatccttgtaaataatcctttatcatttatccttataaatctttttgtcctttattgtagtcttttttgattgacttatctttaggtatatttgacaccctaatatttcacttctcttaatttgtacgtttatctgtatggaacagcttctctcccacccctcaggatcagagctgacctcattttttttttttttcccttgtagcagaggtaatccctgacataacacaaatgctttatatgtgtattaattcattatttctattaaatgtagatatttttgtttctgttttttgtggaggaagaaaactaaagctggaaggcactttattcataattaaatggttagctgtgataccaggcagctgaggtctgtctgactttgctctttcttgggatcacactggtttttgtaactccacggtacacagaatcaataagtgataattatggatgaatattttaacttggatagcaaagaactttttaatgtttaatgcaatccataaatttaatgaactgccttttaaattctctgctgctaaaaatatttaaggagtcacttaaacctgtcatgaactttatagaagaattcagtcttgagtgggaggcccttttttagttcttagaatatgaataaaatgaggagttgggaaaattcatctttcacttgggagtttttgcttctcatcctatgttaaatataataaacttatgtttaaccatattgtcaggtaaagcttactttaaaacactggcatcatgagctttgtttcattcctctggagtcgtaatttggtttttcagtgatttccttagtggcctctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgtcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctccataattaaatcatagtagtatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactgcattccagcctgggtgacagaaagaaactctgtctcaaagaaaaaaagaaaaagaaggtaatcttttagtaatagttgtttatagccatatatgtattgaataactggaggtagggtggttgtgtactttctgccttacattgcagtttgtaacaggccagcccacgtggacatagtttaagttctggcaagttagttctatacaattttttttttttttttttttgagatggagtcttgctctgtcgctcagtctggagtacagtggcatgatctcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaaggtttatcttttaaagtaatttttatattataatgaatatcacttaaggatttacattattttgaacttttttttttttttattctcactccagtgtttaatgcatcaggcaatgtctgttaaagattacatcctcagggtgactacctttggattagactcctggtcctccaccactttcaccctcatgatatgtcataatggttttagtaataactgccattgtttaacgatagcttaagataaaattcatataccatacaattcacttctttagagtgtacagttcattgatttttagtatattcacaaagtccatccgtccccacaattttagaacattttcatcaccctacaaaggaaccctgtaactattaacagtcaccacccatttccccttgattccttcagcccctggcaaccacgaatctactttttgtctgtgttagatttgcctgtcctggccattttatgtaaatggagttaaacactgtggtcttttgtaactgggtgctttcacttagccgaacattttcaagattcatccatgttttagcacgtatagtatttcatttctttttattgccaaataatatttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctgtgataaatattatatttttctttgagtacctcagtttactcattaataaaatgcaaataattgacttgcctaaggtcaccaaataataggtagtgaggctaggatttgacctggttctgcctttcttcagtcttttcttaacagctgcacatctgagcagtactatcagcatgttgataattagaataggtaatttgcagaatagaagttatcaatatgtaaaagaatgagttttagtaaggacattaagagtgggtattctggctggtatggtggctcatgcctgtaatcccagcactttgggaggccaaggtgggcagactgcttgagcctaggagttcaagaccaacagggcaacatgctgaaaccctgtctctacaaaaaatgcaaaaattaattgaacgtggtggttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattcttgtgtctcagcctcccgagtagctgggattacagatgtgcaccaccacacccagctaatttttttgtatttttagtagagacggggtttcaccatgttgctcaggctggtcttgaactcctgccctcaagtgatccacctgccttggcctcccaaagtcctgggattacaggcatgagccactgtgcccagccttgaaattgagttcttttattcacgtaccatatctagtgctctctattcctttgtgaaggtccagatttccacctagtatcattttccttctgtcaaaatgacatccttcaacatttcttatagtgctgatctgctggctttgaattctttcaacttttgtacatcctttgaaaaagtctttattctcctttagttttgaaagatgatttttgcttggtatagaaggttgacagttttcccctgtagatgtcactccactgtcttctggcttaccttgtttctgaaaataagtcagctgttattcttgtgtgtgtttctttgaatgtaatgtttatttgggtggctgtcttcaagattttctttttattcctgattcattggtttttagcaatttgattgtgatgtacctaagtaaagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacagtgtctcaaagatcatgatgctctgtacatttatttttttataatctttttcttttttttggatagtttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttataatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtggtggttctgtctacttttttctagaggtcctttctctcaccttgatggtttcctcacaggagtgtgctgatcagtattcagttaaggaggtactctcttcacatcttcccagctccctgttggttcaactcctccccctccaataatttggcctacaaacttcagccactttggcctttctgacctttaaattctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgaaaacctttatttcttataaattgtcctgttttctctttaaattgagagggtaagttcaatccctaatattctgtcatgccagatgaaggcatccttaatattctttcctaatgaaatttaattttgccacactatttgttatacttctgacacatcagtaaatttgtgaatcagttctacagaatttagttatttggcattatgatggtgtgtggaaagcttcaggtttgtgaaatggatacatacttgattaggaaaatgataagcactttgtcacatttcttatgaagcaatctaaattttttactgaaattataaatgatttaaaaatagtaccatctgatataaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgatagggcacatagaagaaaaacatgaaggctatctaaagtattttattaatttttttctgccatgtaagtattatatcagtgcttcatgcaaactatcaaaatactttagcatcgtctttcaaacttattatttgccacataaccaaaaaatttcagtgggtttcacgtgttttgaaaagcagaactgccatggcaaaagtaacttacttgtctctgtttccatggtttttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttcggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtctttaaaggaatatcatttctttgtcattctcacttccaaggtttggagaagacctcaaatagtgtaatcaaatgtcttcggattccagtattttttctctttgtgtattttgattattactggtaatatttgcatctatcttggatggtgcctgtgatgtgtaaaaatactggaaaaggaagtttttttaaaaaaataaaacaaatattggttggcagttgggagtttataaattacaaatatgatgttataatctataatatatttttcagtgtttttgatgaaaacttttacttaggtcatataaccaaatatgcaacaaaatagagtaatttatatttttagccttttttctttgctcttttatttactcagaccgtaatcagttttgtttcagatagatattaaggatctatattaatttgtgtggttatcacaattattacttattcttcagttctgtattttatttattctccttacctacagcacaagattcattattactgagacagaaaatgttgaatgacattagtgaacattttcaggaaataacattgaaatagtagaagtcagctctccagtctctcaaatactgtttatatttaaagtcagaaaatatgtgtaggagatgagtatgtttatttgtactacacatatgataatatcctaacaaatttttcttccagcttaatttcctaattttattttctgaagagttttttttttttattggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtggcttatgggggggtcatgaaaagaggagagcccttaaattttttttttcttccctccatcatggactcaggtaaagttttgtaattgaaataaaatattttgggaaaggttctagaaagctccccccctccctatttgtgtaaaatgaccattatacaaagaaccttcaattaaccattaaaatatataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttactgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcctgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtcaaataacactgacagacttaaaattagcagctcttcaccctcctgctgccattgtgttctatagagcatccactagcttttagttattgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattatacctgagactgttgttcacttttgaggcaagtagtgtaatgtgattcttttcccttaaaattcagcttttcctacactttcaccttgtttattcatttgcttcattttctttttttttaactttaagttcaggggtacatgtacaggtttttatataggtaaacttttgtcatggaggttgtacagattgttttgtccccaggtattattaagtctagtatccgttagctatgtttcctgatcctctccctcttcccactctccaccctccgataggccccagtgtctgttgtttccctccgtatgtacatgtttacttatcatttagcttccacttaaaagtgagaacatgcagtaattggttttctgttcttgcactggtttgctgaggataatggcccccagctccatgcatgttcctgcaaagaacatgacctcattcttttttatagctgcatagtattccatggtgtatatgtaccacattttctttatccagtctaccattgatgggcatttaggttgattccatgtctttatttttgtgaagtgctgcagtgaacatacatatgcatgtgcctttatgatagaacaatttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattgtgggtttgatttacatttctctaatgatcagtgacgttgagctttttttcttaagatttttggccacatatatgtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactctgctgatagtttcttttgctgtgcagaagctctttaattagatcccatttgtcattttttgcttttgccatcttcatcatggaatctttgcccatacccgtgtccagaatggtataatttgcttcattttgtttgtacagtcatttattcattcatttatttattggggtttgaattaactttcttgttatacacggtctggaagggaaccgaggagggtgggtctcattctatatagaggattttaacagtttcttttccaaacaggattgaaatattgtattcattgtttttttgccccctgattcatccttggtcatttacctttccttttaattctcttgctgtcattttagcggagagtcaagagacgggagagataaccacatgtagctggaagttaggacagatttttgtatgggccatttatatgtgagtagattaatagaagtgtgtcagacctcatttcatttaaggcacatcaattaacttgaaattgaaatcttagagaagaatattaaagctccaagttggggacaggaattagaaaattgcagaagatcctgagcaaatgtcctgcatgaataggatcatgaccacacgatggataatagcatgggatataggagatgagcatttgaatggaatatgcttgacaaatgagcttagctgatgccttggctttcttaaaaaccttgaagtaggctggttgtggtggctcacacctgtaatcccagcactttgggaagccaaggtgggcgaatcactcaagcccaggagtttaagaccagcttgggcaacatgggaagagcccgtctctaccaaaaaaatacaaaaaattagccaggcatgtggcgtgtgcctgtagttccagctacttgggaggctgaggtgagagtattgcttgagcccaggaggtccaggctgcaacgagctggcattgcaccattgtactccagtgtgagcaacagagcaagaccctgtctcataaataaataacccaaagctttagatatgtaaataaaatgtgtttcatattgcttaggaaaggtatagttggctggatgaaaatgtgtcttgctgctaatgtttcatatatcattttttctattaatttgaataacctttattgtttcatacaccaatttttctttattttttaactttaaaacattttctgttgtctatagctttatgttccttataagtaatttcttctatgagaaacctgtttctctttttaaaaaacctgttttgttttcttttttttaaaggctgtttttaaaaatcagttatatatatgcacatggtttaaaagtcttggtctgcgtatcctaacaaaaactaggggtgccctgcatgtttctttctcttgttttgtatttctagaggtaaccacttcaaactcttcttagttgcttcttttgctgattacctccttagctatgaattgcttggttatattgcaacttcaaattttttttcagtgttaggcttttcttgttttcttttggaaacagggtcttgctctgtcacccagtgcagtggctgagtcatggctcgctgcagtctccccaggctcaggtgatcctctcacctcagactcccaagtagctgggactacaggtatgtgccaccacttccagctaatttttgtatttttcgtagaaacagggttttgccatgttgcccaggctggtcttgaactcctgggctcgagcaattcacccatcttgccctcccaaagcgctgggattataggaatgagccactgtgcccagccctgtgttaggcgttgtctgtcgaattccaactatggaagaggaagattgtcttttttatccttcttctgtcatcacagacaggacctttctattcccttttcatctcatttgttacattataatttcaagtaggttgaaattcagtgcttatgtttttgtgaccacaaattttgttcatatctgagccatgtagttaaccatgaaatcttttcccttcctataagtaactttgttttccaagaagtcattaataaactgtttgcttagtgctaaaataattaccattcattcacctccaaactctcttcagtagttatataaatctcttctcaggatattcagatgtatagggtttattcatcagtttaattttctgaagtgtcttttacatcccaatctgaacttgcttctgtcggttcccagtatagagttgccatattcctttactatcattctagggattccctttccctctctcttgtgttggatctctttttcgtatatcctatgtctttttcactcctactgtccgattctttattttggtgatcatcttccaatagagttccttttagggtgcatgagagaggaaaatgtctgaagtgtattcattttatcttcacacttgttgatagtttgggtatagaattctaggttggaaataattttccttcagcattttgaaaccattgcttaattgctttccattataacttgaagttaataaaagctgatttatatgtataggacctagtttttttttttttcccctgtacaaatgcttttaggatcttccctttgtcccctagcatactgtgtgtgtgtgtgtgtgtgtgtgtgtgttttttttttgtctttttgttttaatctgtaggttatttcttcaactttacctactgagttttactattggatttttaaaatttctggcaacatttttaattctcaagagcttcccccacccctgcttgaatattcttttttaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactccagcctgggtgacagagcgagactttcatctaaaaaaaaaaaggacacagagatatagcacagtactgaataaccctgttcgttacttttgcttgagcatggtatagcagaaaaactatcttataggtaggaaaaggactatgggaaggttcatgtgtgtgtgtgtgattgttttaggcaaatactgaagagtatagccaacaaaggacgacgtaaagaatttacaagttctgtgttagcaatttgatacagttttaaaaatgagtattatggaacacatttttgtcaggttaatattctctgtacagattttggagaagtaaattttttatagttaaagtaaatgataggttctcaggttaaagtgtcactatgggatcataaaaatacagtggtttgagaactgaaggctctttaaaagatttcacagtctgaagctgaaaatgattgtcgaagatcatggatgcgttcatgggaaataaaatttttaggattctgattctgctgctcactccacttaatcagtaactaagtcattttctgccagcacatgagcttgtctttaaattagttatagagccagctgagttgagctctattctgttttccctgaccctagtctgtaggttgggttctaaaggctcagtatgagccacattttcatacctagtgtatattcctcttagaattccgtatgtacactcctcagcatgcttcaaaaagagattttggctgccaggttcttttcttttattatgataataaaggtcagtagaatctttcttagtgatgtttttacatgatctaaatgaaaagattttgtattagtatgtgtcactttgataacattaaatctcttttcattgtatgcgcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaaagaaaaaaaaaaagaaaaaattgacacatgcctaataattatcaatacagttatagactcagtttaataaataaaggaatattgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcctcagccctctcaagtagctggaactacaggtgtgtgccaccatgcctagctagtttttaaattttttgtagagacagggtctcgctatgttgcccaggctggtgtcaaactctgggtctcaagcaatggtcctgccttggcctcccaaagcactgggattataggtgtgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctctacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaacaaggctatagtaaatatgcatatgtaatagcatacatgtttggggagtttcttcagagtttgttgtaagaagtggagttactggtatgtgcatttaaaattttattagctatttgtattagtccgttttcatactgctaataaagacatacctgagactgggcaatttataaaagaaagaggtttaattggacttatggttccacgtggctggggaagcctcacaatcatggcagaaggcaaggaggagcaagtcctgtcttacatgatggcagcaggcaaagagagaatgaggaagacgcaaaagcagaaatccctgataaaaccatcagaccttgtgcaacttattcactccatgagaacagtatgggggaaaccaccctcatgattcaattctctctcaccaggtccctcccacaacacgtggaaattatgggagtacaattcaagatgagatttgggtggggacacagagccagaccatgtcactatgttactattgccaaattattctccatagtggttacatcagtgtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctactttctatatttagagatagattcttcatttttttcatccttgttaaatattgaagcagaacgttgatttagaggaatgatatggcttttttcaaagctgtttgaaaaaaggtatttcatgtgaataaaataccttctgcttggaagattaccaagaatgaggactttatctgagacttccataatcattcagaattacttaaaagtaaagcacagcactctagggtttgctgattgttgagaaattgcatgatggctgactgttgtcagtgcctatattttgattatcttgagtaaacctatccctaggaatgcagtaaaaagtatatgttttgggtggaaggcaaaatattgaactctgtccctataatgtcatgacttcacacttcaggaagtctactcaatagacttttaaaatgttgtgtttgcttttgcatccccttcccaaccaaccaaaccaccagcccacccccattcatccattcatttgcccatccgtctactccccttacccacatatctatctaccctacctcctacctaaaaaagaagtcattgggttttgcaagtataaattctctgtactgagaatcctactaaccacattgattatgtgaatgaacatagtgcatgttctggtttttttgttagaatacttaaaagattgaagttgattgtcctaatggtatggttatggatgtattaaagtagctgtttagtttttaataactcattacagatatataagtacaaaacaatgctgtatgtttctgagtatagtattttaaaaaagtgagattgtttaacatttttaagctctttttacacttgtaaataagaaataaatttacccagtgatcagtaccgtatcgacatattgaaagaaacagattgggtgtcccttttttgaattgcttcataccagaagtgttgcaggttttgagtttttctggattttggagtatttgcattatatactggttcaacatccttaatccaaaaatctgaaattctgagcatttcctttgaacatcatgttggtgctcaaaaagtttttggatcttggagcattttggattttcagacttgggatgctcatcatgtataggaaaaaccttgtgttttggaggactctgccttcttcaccttagttttacttgctagtaacttttatagatcttaatagcatgcctttatctatctatctctggctttattttccttcagtctgtaatttttaatggcaaccaaacagttttgaaaaaagccatatcattctgtttctataaataggtgtgtgtacacacacacacacactaaattgtagatatgatggttcattatccccaaacattttagtatatttctaaaatcaagaacatattacaattatcaaaatcatgaaattaaccttgatccagtgttatctagttatagaactgattctaattttaccggttgtttcactaatgtcccttataacaaaaggaaaacaaaataccttcttcccccttatccaggatccaatcaaggattgcatgtttcatttacttattgtgttgcttcagtctgttacatactcaatgttttttgtctttcatgaatgaatgtgacatttttgaagagtacagccatttattttgtagcatatccttcagcttgggtttgtttaatatttctgcttgagtaggttcagattatgtacttttggcagtgatgccacagaattgatattgtatcatttttagtgcattgtatcagtagacacatgatagaatttgtcctgtgtgtgaattttgagcttttggttgaagttgtgtctgccaggttttttcactataaagttattatgttttcctttatatttaataagaatctaatgaggagacactttcagactatcctgtttctcttttaagtttcagtcactagtttttagcatccattgtgattcttccctaaaacagttattactgtggtagttgctaaatggagttttgcaatttctgtcattccttctatgtttttaagacttgttttactataagcaagagttttcccttctcccacattcatttattcttttagtaatatctatatgaactcctgatttctcattttgtggtctatatctttaatatcactgtaatatcataatatcagtaataccactcatcattaattttaatcccacatttttttttttttcagatttgaccagtgggagttattcaaatggctcttaggtttttttttttgatgcagccacatctttttttttgcctacttctgtacttcccggcacagcaaggtgtttcaggctgatcttgtactttctcttttctggccctggaatcagccctttttttctccttttctttcttcaagacacccttgtcttattcctgttagtggagaacgttactaagaaaccaagctttgtgctcattgctgttggggtatcactgagtctaggccttctcagtgattagagctaggggtgtgtgtgtgtttatacatctatatctaattctctacataaattaaaaccatgaatttttacagacgtctccagttatagaaggttcactctagttttctgcccttccatattgtaatgcccttctctgacagtgagaaacctggctcctattatctataatatgtttatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgctatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacggtgagtgtgatgaagcttacttttattttattttatcattattattttatttatttttgaggtggactttcgctcttgtcacccaggctggagtgcaatggcatgatcttggctcactgcaacctccacctcctgggttaaagtgattctcctgcctcagcctcccaagtagctgggactacaggcatgcgtcaccacacctggctaattttgcatttttagcagagactgggtttcatcatgttggctaggttactcttgaactcctgaccttgggatctgcccaccttggcctcccaaagcaaagtgttgggtttacaggtgtgagccactgctcctggcctttattattattattattttttattgagatgaggtcttactatgttgggccaggctggtctcaaactcttgggctcaagtgatccttccacctcagcctcccaaagagcgctgagtttacaggtgtgagctgctgcgcctggctgaagcttatgtttaaatttatatatatatatttaagatagaagagtccatcaatacttggagaagaacaaagcaaattcctttaaattgtatctcaaaataataggaaactttgtatatatgtgtttgtagtattttaaaaattggaagtaatttaaatttaattggaagtcatttgaatttaattttttttttttttttagcttgctagacattattttagagtgaccattttatactatgttttaaagtttatctgtagggaaagttctgttaaaactggtaatttagtcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataatttttgtgaatcttcattctttgagtatgggattgtaaaagacaaactatatcctacagtagtatcatcatcagtatcaaaggtctcctttttttacttggaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaatatgtcttttccaccggcgatggttgggtagttaagtgaataagctagaaagacatgtttataaagctatttgatgacaatctcaggcatatttatacagagatgttcttaactgtttgctacaaaaacatgaagatcaaaaactttcttgaagcttacgcttaacttatttggggaaacaaaactccagcccttcttgtgtatgttctgatatccctttgctctacttttagaggagtgaaccctaataggatggtagcagcattcttgtttctttatatctctcctctgtgattgtataccgttttttcaacttaaagcaacttcagctggaaatatgtagaggttggccaaggtgaactaaatagtctgtaacattgattagatatcaagcaacgtgagcatggtagcaaaagcactaactgaagccagtgatttaatttttaattctgattctgataattgatgatatagctcctcgaactttgttttttgttaaaacttggaaaatatatttgtattattttggacaaattatttgaactctctggaccttgattcaatttatatataaggtaaaggcattatactggattatcctgcaatttctttgagttgttagaatataatgtagcttattaatagcaatattagcagtgtagtagattctgactgcaaaacctagccttttctattgattcattagtggtagtaaaggtattatctgatttatcctttttaataggcagtgctttgatcaagtgggaaatagtaatggacaaataaaatcaatgatcattatctaacttgatgcctgcttttcaaaaagtgagcaaatttcacatcttcacccttagacattaattcatggcacctactataagtactcatcctcttcttacctatcttcttttctataggagataaagtggttattcagaccccccaatacaattttttggtttgttttcacagctacttaaaagattaaaataactattcttgcagatatttctaggaatatttttagaaataatatgaaatacagggataataggccaattatgatctttatttttaatttctacagaaaagtactagagaatatatctatagaaacttctttcagataaccctaaagatgatactagaatgtttataaaattattgagaagattatttgtgttataaagcttatttgtaccata

SEQ ID NO: 14428 - DNA, 9073 bp, Human
atatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacgctgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcagcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcagcaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgccacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaactatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggatcttgatgtttctctttgtatatatgtgatgagtttgaaatatttgtatttccttgcagattttattcaaagcaaaaaaactttttaaaatgaatctctagcactttctttatgataaaagtaagcatgaccaaaaaatcacatctgatttgtcagattatgtagcattataaataatcaagggctttgaaataccagttgttgctacccattatacaggtatcattagctatgaaaagataattttatctgaatctacaacaaaagtgtaataagcatttacttacgattgttaaagaactttcatttgtctgtatccaggttttactcatggaacacctatctccaaaaacactcagactatgtctatacaagtaaagcagcacagtaatatcagatacacagccaggcaaaatgaaactcaggctatccaggagaaaaaaagtaaattcaataatttccacctgagtcatgtacaattcagtttaacttactttaatgcattggtaaaagtataacataaaacatttcctgaaagaacaaattatacattagctgtcaggacttgctaactcaactgtttgcttcagaagtttttcataattagcaaaagtaatcacaaactttatctttcatagtggtgagccatttattactaaagacaatagagctaatcgtgcaaattaggaaaatcaattaggctattcagtaagtggagtccagtttttctattttttgttctattgcaaaggatgattattcattattacatgggggataaggaacctccttgggcacaaatttgaactctgcattattggagttcagacatacagagatatattcgcaggcagtgaagaaaggagttgagagcagcaattctgaactggagccagggcagacaagagtgcccttgagaaaaaactcagcataaaagaaaaagaaatctaggactctagaattgcaaaccagattcatcaagggaacaacatactatgggaccacttaactaatgacacatgtcattccgtaatcaaccagctctgagatgcagcagtcaagtaccatagtctcacctgcatggcaaagtgccagctcctccagtactgagaaggagaaatcaagtttcaaccttcctagtaccaagacattatagaggctgcagcttggaattgtttgcaggtgaagtggcacctcagtgaaactttcagggacaatagccgagttctggcttgattatgggagccctgtcttgttagccatggtaacaagcaacaataggcctattctgaaacacagaatatacctttttgaggattcctagttataagagaaagggaatcaacaagggccttaaaagcaaggcacaaaacatctagattccatttttactcatagattggtaagaactaaatcattcacactttgtagcttttctgaagtttttacaatggttgggtaatattgttatgagccaaataaaacaataaaagatgtctttaaaagaacaattataatgttctggtataagcttgaattttactcacctcgccaacatctatagagcatattccatatgccaggtcagtgctaaacagaggatatatcaagatagaaatgatctagtctctactcgcagtcatggggaagacaaattttagtgcaccaatggattctaaatgtactggtatcacttaggaagaaatgaccagttccctttacaagagcaaagccaggaaagtataaggttgagccagaaaaaaataaactgttgtttgagctgggtattgtgtatgtaaaagttcctcagaatgggagggcagggtgtaatgtgatgtgttggaagacctagcttagagtggctgcaacagaatatgtgaaagaaataccagattacatatagacaaaggatagataggtcaaggtcattgtatgacatgaaactaagtttgggttttgccctttagggagtagggaagccagtaaaaactttaaataggag

SEQ ID NO: 14429 - DNA, 96987 bp, Human
ctttggagggaaagtaaaacatagggaggctctggtcagtgggtgtattatacataagtaggaattcctaaaaaatgttagaatcgcttgagaaattaaactggaatgtaatatcaatgctgagagacgtttgtcagaggaactcaaggtaaaaatagctgatgctatagcaaaaagttatgatttatcatttttatgtagctatcatactccaggcctggaaagtggcccatattgtaccagttttttaaaggaatgtagaacgaagaagattgatctcctaatttataagtcactgaatcttgccttgatttcagaaaaagtaataagaggacttcatgggagatgagagagattttcagagagttctcagctctctgactgtcttcaggagactcgagccagatgaagaatggtcatttctagtttctttactttcattttgaaaaatcaggaaacaattggaggaaaatgtgggaatcactaaatatgcctgccaagatctcatgaaatctgttctagaataaaaccaaaaagacaattaaggaaatgggatgaaggggtaaaattctgatttcagcattaaatctaagctaacaggcatgaggcaaagggcagaaataaataaccaggttttatatgagaagaaactaacaggatgttcttgcatttaatagtagaagcagcaatttcagtatgttaatcacttacctggaaggacagaataaccccgatgaaaaaaaccagcatatgattttcctgcttaaccaaatcactttcttggctcaagtataatggcaaggtttgggggaagagacttgtcagtatatggcagtacatgacagagccgtcatttgtgccccacctatcaaattttgttgaaattcattatcaagttcaaaattgccttttctaggcaagcaaagaggctgctggagctgagccatccattcctccggcgtttactgcaagcctagtgcattcacagccatgaacagcacactgaggaggacacaaaagaagtagacagaatctctgcctctgcttaggagtatgcaatttagttggggcgacaaaacttaaatgctagaaccaataaaagaagattacaaagcaactcgcaagtaagtgtataataatatggggcaaatgacacagataaatggagagggtacaaggagggaagaggagtgagcaaaacacaacagtgtcagatcagtccgaaagggcatgttgcctaacagttgtatgtcttccacgtttctttctgtagcatcaatgaggaatagtatggggtaggaaattcagatatacgacattgatctcttcctccttacctgcaaagtctgtccatctgtcatggatggaaattaaattgattcaaccatttgctctccacaaagccatgttggtttctacctagtaatttatgctttccttgctgtttgcaaatcgattgctattatgggatgtagataaatctgggcctggatccagtaggttgggagattattggagtgggtatgtgtacttgtgtgtgaaatcatggaaaagcggactctcatttctgtgtattttactcattgaataaaaacatactttcaggcttttaaatgcacgtttaattacacttagattgcatttttaagagaatatatctgctttatttcatattgctactgacaggcctcaatatttgcctaaccttcaaaccatcttcaatggctttgtagccagatcttttgtttcaaaaaaaccttgctctagcccaagaaaattatagatcaatacttgtgtttttcttttgacatagaaatatgtatatgcattcatgtagtttgatgagtaaaatgtttctatcaaaagtcttgggaaagtgtattttatttaagcactcaacttcatttttataccttcaaatttttttttcgagtcctttgaggattgtgaaattctttcaaaacaaattaaaaagaaaacattttctgtgatttctttacagattctggacaatcaggaagtccaagccacaatgatcctgccaagaatcctccaggtaaatatgtgttccaggacatttgcaatctgacattgttggagaacaaaggtaccactgtatagataaacaccccataattggtcagctgcctattttgttctggcaggcaggtatgatcgggacaagatgtgattgtgcttaggccctttgcagtggcaaatacttttatattggcgtcatcagtatttacctaatcaccaatgttttaatttttgttggtgtttctttgaaaataaatacgcatatattttagttgtgtatcttttaggtgctaaaataattgctgtttgaaaagccaatgaaccttttaatctttcttttaaaactcataagaaaatgtaaaaatttccatactgcaattatagtttatcaactctcattactttagaagggggttgggggtgggagtggttggttgtgttttcactgaaggatttttgcaagactttttattccataaagtttttattggatctccagaatcaggaaataatgaaagcaggattttttttttctttagcataaggtatcccaaataccctctttgttttcagaagttgttccagatctgaaaatgggcttttataacttggctgtcttcatatagctctgaacatacaacattttgcttttgatttaggaacagtgttttttctcatgagataaaactagcacaagcagtttttcattattaaaagaatgtgaattatattggtgactttagtaaaagagtgctctaagaataaactaacaaaaacaaaaccaaacacaaaaaccccgaaccagctacacatgccccccacctccccaaacaatctcatctgtcctttcgttgaaaataaaccagaaagtttatatgaagtaataggaaaagtttcctcaggtagacttagtttttaggtcctccatcgtttgatcttccttgaagtcgtgcttagctaatatgaggctgaaataccagaagaacaccaaaattgcaagaaagtttatcagaccaattttgtcttaaaatgattttagaaagatacagcaagtagatatacaagtaaaaatgcaaaatcaaaacagactatatttttctgagtcctatgtttttttatttcagaaaaattatctttttccaaatatttattaattctgtattgtacaaaatcatattgttgacaaaagtagtatacacttcaaagataaaaagttctaattaaacacaggtttaaaaatgtatgctaagttgatttttcattttcttcataaatcatttaaatattactgtacattgagagcaaaacattaaaaacagaataatttaaaatgtaattcccagttaaatttattttattttgttgtgtgtgaatggaggattgatattattttagttatctttccaaaaaggctacttagaatataataaattttgtcaaaaattttcagaagttcagaatatttcattaacttatagggtcttttaactttacaaagatttttttctttttaattaactgatattttccctgtgttgcatgatagacaaaatgaattttatccaaacattttttaaaagtctccttactcatcttacaaagaatgaggtgggagaagaggggaacctttggtagaaaaagagttgatagctattataagtcggactaaacaacggatatgttttctgcatttgaatgaaagcttgatttgaaactaataaagcagttattgtttgaagttcatttctgaacatgtacagaaggaattatactcacctaaaactgttctctacttgagctgaataaataatccttgaatagttatgtaacatcattcaatttttcaatatttgtcaagaagcttggttaaaatttcatttttgctgcattcgatgtagcatctctttatttctctgtttgcatataacatggcaaacaaaaacaaccaaggtagaacacctctaatttttttcccttttaaattttccttggaactcaaacctttttgagactgtgtcctgaaactgggatgctacagataaatacattttatgattagttgaaaattgtatatatgtaaatcgtacgttgattctatttttttagagccagaatgtaatataaaatacacattatacccaacttaaatggaatataattagaattttatttaattatccagaatgtaaaatattgactttaatatgccttgtgtattataatactatgaactcaaccataaggcttattaaggaattctattttggacttaatgatagagattattaaagaattttttatgagcttaagagtttgttttgtaatacttcgaaataaattaaacctagaatataaaatgttttctaattttaaatgtgaacaactagaacttattaaggtttttgttttgtagtcaactggagtaaattatactttctattaaaagcttcttttttaagtataagcatatttggtattttaggacataatttatctttaggaagctctttttatctctgtattcttgccttggccaaaatatgaaatctccaaaattgagattttgtgtcttgagaaggcacgatccatgtatgagaaaattcagtctaccaccacaagcaatgaaacaatcaaatcactttgctgcttgaattgttataccaaatacaagctaagcttttgaaaaagatcaccttgaataccaacactttcttatcactggtagttttccactgggagatgtgcaacccatggaaattgctaccgtctattcctgtgtttattccccaacagcttgggaagagatggcaaaaattcaagcccttttggagatataggctctttgaaatctgttccccactgttgacttgaaggtggaatcccatccgatcatcctataagtgcagatgcatatgcctacccacaaacttaacacctcctctggcttggcttttctccagcatcaggcttgaatgtctgactttgagactactttcttactgacttagaacttctgaagggtgaccctaaagctcttcaaactatagtatggacatctacagataggcctttagttcttactttgagtttctgtgttggaattagtatttaagcacaagcagcaaaggcaacgcatttttggaaaggaatatttgatattattttataaaatatttaagtaattttttgtcatttgttattttatagagcttttaagtagcctttatggtatttctttaaacgatttgtgacttaaatgttttgtttgcattctttgttacgtggcaggggtgggcaccgtaatctttttggagtgaaggtgctctacaactcagatagcacccaaggacatggcattgcaattttggctgagaagcgctaagcacttcatttttctagggatacacatttgccttgtttatgatagagtcagaagttatatatttatattcacttcttcttctttgttttttttttttttttttaacaagttaatccctcctaagcaatagaactaaaaatgtcctctcttggttatagcaaacaactcttgtggaccaaatgagggtaaaccattaattttgggacttagacatgaatctctttttacctttaataattaaaaactccactgctacttttaggaaatgtgtgattgattggatggtaatctttggaaattagctttgacttgctttattattttgtgtgtctacattctttggactatgatctttaagatttcccaatctcaatcccttgactaatcctagaatgggtaaaatccaaggaaaacatagcaatctagaattcagatttttgcttctaagtcagttccaaactaatgtcttattttggagttcaggaaggctggtagttttgtggggaattctctgctggtaatatgacgaagacatgttaaatgctagggcagtttttgcaaattttatgatataaacttttggggcctttctagtatcattaagcagaactttcttaccgggaataacatggacttaacatgctactttcctttttgtaggttttataggtgcttgtgctattttgtgtgttgacttatgcatgtagtgtggcaacacctctgggaaccagtaggattatatattgggtgtacctcaagtaagccaccttatatcctctctggagcaaggatgacactaaataaataactgagtaaatcaaagaaggattatctattaatgatagctatgtgcttatcttgcacttaagaaattctttaagtcgctggctgggcgtggtgtcttacgcctgtaatcctagcactttgggaggccgaggcgagtggatcacgaggtcaggagatcgagaccattctggctaacatggtgaaaccccgtctctactaaaaatacaaaaaaattagccgggcatggtggcgggcgcctgtagtctcagctgctggggaggctgaggcaggagagtggcgtgaacctgggaggcggagcttgcagttagccgagatcgcaccactgcactccagccatcctggacaacagagcgagactccatctcaaaaaaaaaaaaaaaaaaaagaaattctttaagtcataaaaattttgagatagctctctctccaatgttattttatagatactgaaatcaaagccaacagaaggttgtcataaaactaatagaaacaaaccaaataattattaggaaaactagttcaaaatcttcagtattcattgtcatttgttcatctgttgagatcactagagccgatatttgcttgatttttcagatcttagaatttaggacaaacttagtactttttaatctgtacataaaggcagataaattcgcataggtccttgaggacctcataccacgttttatcttggaatatggtgttcaaagtcaaagtcaaagaaaagagaaatttactctggctttttcaaatcatatttcattcactttttttttttttttttttgagatggagtctcactctgtcgcccaggatggagtgcagtggcgcgatctcggctcactgcaacctctgcctcccgggttcaagcaattctcctgcctcagcctcctgagtagctgggattacaggcgcctgctaccgtgcctggctaattttttctatttttagtagagatggggtttcaccatgttggccaggctggtcttgaactcctaacctcgtgatccacccgcctcagcctcccaaagtgctgggattacaggcatgagccaccgcacccggcctcattcacttcttaataaattcatgtctattccttctcatgtcctcatttattgtgtccattaggatcaagatgtttttaatgaggaaaaatgcactatttcatgatacttaaaaggtgattttaaactttggcactagacaatgtgcattcgactataaataggctctctattcataaaaatatttggagaaagatgctgaaaggactggttaatggcaggtaagacctgacatcgtaggtaaaacctttaagtaatttgagaatgaggtctgtatgggtcagtgctaaaatcaaaggactttttttttaatgtattttgttttaaaacatttttcttctttatcctctaacttgtttggagacgtcacattcaataaagttcttaaatgttcaaatttagaataggattcagagtaaaggaagagaggatgagggaagtgtttctttcacaaattactcttaaaaagccagaagaacgcatagccctcagctacataattttacagggtacattatgggaacttgtatacagcccactcatgaaaggttgatctacatagcagttggcaccatgcccagcctccacagtgcttctagcctgattatttgtaatacttaatgtgaaagagtcaaaaaaaggggacaatttaggaatgtcttgtaaggtcctgagagaaggagatttttccatgtctccccagtcacctactctatcagataacaaattatattaattgcctaacgattgctgagttaacaattaaatactacatttgagtcagctcaacattagaagcagagacagccatttgcccttgtgtaaaatacacaccattttataccaagaaccataaacaattcagaaagagctgtctataggtagatttttcagccagcagatatttattgagcatctattgtatgcatcacactcggctagatactggagaagataaaaatgtgagttacacatgaaccttgcttttcccaaatgtttttgttcataaaatctacaaaataatatatacataattataatatatgaaatgtatattacatatgtatttatatttaagataaagactaaatattagtgttacgatgcaggtcttgtaggagttcaaagttgtgaaatactgtttcccaccattgtaggtggcatggtggagtgaaaagagcatgaactttggaattaaaattttcccttgaatgattataagggtcatcaggagaatgagcaagtcagccaaccgctttgtgcagtcaattatgttcatgccagttgtgaggatcacataggggagcacacctgacagatagcaggtgcttgataaaagtgaggggttttttcattctactttctcttcagctagtttgatcaagaaggcttcctgcagaaagtatcatttgatgtggaatcaaatagaaatgtgttgaattgtaatcccagcactttgataggctgaggcgggcagatcacaaggtcaggagtttgagaccagcctggccaacatagtgaaaccccgtctctactaaaaatacaaaaattagccgggtgtggtggcacttgcctgtagtcccagctacttgggaggctgaggcaggagaatcgcttgaacctgggaggcagaggttgcagtgggccgagaccatgtcattgcacagcagcctgggtggcagagtgagactccgtctcaaaaaaaaaaaaagtgttgaatttttatactgctcttctctaaaggcttaagatgacatacccaagttacagaagatgcataagaatagaatgttagagattttataaaggaggcaaaagaaacagatgctttcaagtctcatgatgaaatagaattgtaatttttagaaagcaaatgttgttataagcctattggcataaaaggaaaggtggagtgacttttgttacataaatctcagtattgacatgagaaaaggtacaaatgtatctttagagattacttttttcctaccaagaatttatcttgtagaagcttgtattaacattgtataatttttttcccctcctttcctttccatggtgtttctactttatgaagccatcaactttctgtgtctattgaaacttctgtctgtcctttacttttcctagccctcttactctgcctcttatttcactgattcctacctaccaacttatttcttattttaaaacatacatcttttgttcctcatttggacaaacccctttaaccaagtgtctcatctctctctcttcttcttcgtaacatggcatgaaggatgtcaaagtctcatcttgatttcccctgaaattccatcttgatttcttctcagcttctgtccccactgaaatgattctcattaaatccatgaccagtggtttctttctgtcctgttcttgcttccatattcctgaatatttatttgatttagttggccatgctctgtttaaaactttgcccgtgcctctgaaaacaggacctctcctggtaatccaggaaccttcctatgtttaaaaattgcatatggtgatttcttctgtcttcttaatcagatttttgtctttaattctctgtgttttcagtaccttgcgatttttaaagtatattaaccttttctcctagatgtttacctttgaaatacctctctctcctaatgatttagacctatgtgtccaactacttttcggacatgtttccctagatgtctcatggttaactccaatttaacatttccaaagttaaatttattttattttaccagacttgggttttttgttttctttgtttttgctttttccctttttaagatatcctggagtcaccagaatcctatctagatacccttggttagagttgctcatgatttctttcccaggaaccctttttcttccttatcctccacatattcattcatattctactttgaaaggtctcttgaatttacttttacctctcagttaccattacccttatttgacctctgaacactgtttcttgcctgaaattgaggaaaaacctttaaaaaatgtgactgcctactgggcaagagatgtgtgcacacaagtttatatttaaaggagcagtcatagtggagtcagagatgtctaccccttcccagggaatataagatgcatggaacagtttggataaaaggatgaacaagaggttgtagggtggatatagtcctagccgaggaaagagcatttcacatggaagaaggggaaaggaagggaacttggtgtctgagcaaggcttgagcagcatttaaagccgtgacatagaatataggttcataagtagtgagtcatcaggggtttttcagcaagtcagatttgtgtttcatgacttgtgttaatatacaggtcagagaaagaaagaatggggagaagagttaatttcaacacagtactctcctttcacaatgctgtcagagaaaggactcgttcatgggctacagttagttcaaactttccttaactttacaacggtattttaaggtctcgtgttatctgaaatggtgtcataaggtaacatagaatccaagtaaaattttaatatattgatgtaggcacttaattaatactgtacctagttccagaaaacttccaagagggcttgcacagaaatagcttgtaatttgctaaattttaaaggctattgctataacctatatttttcttagttgaatgtctaggttccccttaagggagggtcagaatcctcatgtgaaaagacgtctgagtcataaattcctctaggtgaggttgtgatggtacctgctgttctgggcagtgttgtagtgatggcttttacccaagtatctcatgtaactccccctctccccgagatggggtcttgccttgttgcccaggctggagtgcagtggcatagtcatggctcactgcagcctgcctcctgggttcaaacaatcttcccacctcaagcctctcaagtagctgggacaacaggcatgtgccaccatgcccagctaatttttaatttttttgtagagacagagccttgctatgttgcctaggctggtccccagctcctgggctgaagtgatcctcccacctcagcctcccaaagtgttgggattataagcatgagccaccatgcctggcctcaggttccttctacggtggcctcctgcatccaaagtttcctctcagtttaaattctttccctctccgtatttacaagatctgcttttgccacatacagctacaatttaataatgcaaagcattttctgcctcacagacggaaagctgggattgttttgtatcacaaatatagtggacttgctctaggcttgttaaaatcactgaactttgcagaagttaagctcgctggactaaactgtccaggcactaaggcaactctcacttgtatatttaagcataatgtttaaaaagagagtacaattctatagtaatatattgcaaacagaataaaatattaagtagatatgtgtctaattacccgaggagttttaatctttttctaccttataggattaaaggatgtgatttaaagatcttggacaaatctcctactaaagtctcagtttttctttccttctccgtgactatgaaagcgtatctaggtaatgaataatttaagcaaggacttttgtgtgttaatttgactgttgtttgtttgtttgagaaggagtcttgctctgttgcccaggctggagtgcagtgacatgatctcagctcactgcaacttttgcctcccaggttcaagcaattctcctgcctcagcctcctgagtagctgggactacaggcatgggccgtgtccggctaatttttgtatttttaggagaagtggggtttcgccatgttggccaggctggtcttgaactcctgacctcatgtgatccgcccaccctggcctcctcaagtgctgggattacaggcgtgaaccaccacacccagctgactcttattagcttttgcttgataatgtcattgatcatagaagaatttaagaaacaatggtcaggttttggttttcaaagttgttacaaatctttttggggtcttttgacttacattctgctctttagggaccttggcatctttcataccaaactcctgtttttgctgagatattttaattcctgattccactagacatatcttccccttgcgcagtgctctataccttgcatgtatgtgtgttcctgcagtattcagcaggaagaagacaggaaaaccacttgactttcagatttgatcttattaaaatcatcacttccacttgttaatgtcatgaaacaaacagtgacatgatgaatggtaagatgctggctccattgtgtattttgcagtaatgttttcaatgcaatggatttttcattttaaaatttggtattttggactgctgtcattttctgaattgaagtactttctaagcagagcagtattttctaaataagtaagatagaactagaagatgatcatgtctgttgggacatgataaagtattctgctattttatgcttaccatgtccaaattgatatccaaaaatagcccacatgaataatgttaccttatataatgttgatgggtgaagaagggagtacttgtgagcttttgggagaaagaatgtagaaagaacagaggaatgaatacaaaggctcaggctgctgatgagaggggcaaaatgttttaaaaagaaggtaattgatgctgaatcttaataactctttaaaaacctttacactttgcctctttaactagctcacctagatcattttaatcatttcctaatctctgtagcgatattttgcctcatgtcttaatccctctgatatatccattacaggtctgtggtgatgtgcaaatctgattatttcattcacctccttgtatggttccaaggtctccactctagcctaagcctagctcgttagcatgacatacaatatgacccttcatgatttgtccgttgcacacatggactatgcctttagcgttagccgtgtgctgcttctttgtatctttgctcatgttgtttctctgcctagaatgcttgtactcccttgtcacctcctcagtgagacttcttcagagcctctctgcagtgctgttttacagtactagcatttagtgcactattttatctctattttcgcatctactccccttaatgaattctgagcccctttgggtgagtattgcattcttcttttttgtatacctatcatccaaggcaatgcctacctacagacaatgtccaagatttatgaagcagaggcttagaccaataatagactaaataaataacctgttcttgcagtgtgtgggatcattcccttactcagaacctgacctaggcctagaaaaagcgggtacttctgcggagatacttacagtgatcctcttatgccctgtaggtataccacatcctagacatgattatttggaatatttttctgaactcctcatcttatgtagcatactgatgatgaattttgtagagaggtatctgactgagaattgtagcactccaatataattgctgattcagaatactaatctcaggtggatagagtttctcttctcccagtttgacaaattatagagaagtcctgtttgctgcttttgtgcttttgtttactagggagtatactacagtgttcttagagttcacttgaccatgaatgaggaacctggtaagataacattctagaagctgcaaaaaaatacctgactgttgtaattcataccttcaaaaatattcctgattacactgaatgtttctgattcacttgtgattctttttgtgctgtggaaatagcactttttgaaaatttggaaaccactctttataggtcacttgctaactttattgaggtataatagcatacaataagttgcatatatatagtgtacagttagatgagttttgacatatgtgtttgtttgttttgttttgttgagacagcatctcactctgttgcccggtctggagtgcagtggtgtgatcttggctcattgcaacccctgcctcccaggttcaagcaattctcatgcctcagcctcctgagcagctggcactagaggcgcgtaccaccatgctatgtatttttagtagatgtagggtttcgctatgttgtccaggctggtcttaagctcctggactcaagtgatccacctgcctcggcctcctagagtgctgggattacaggcatgagccaccacacccagccagttctgacgtatgcatatactcatgaaatcagtaccacactcaaggatgatgacgtttcctctaatcccaaaggtttcgtctaccctcatcttcagatgacttattgatctgttttctgtctcttccaattagtttacattactgaatatgttaaaaaggggaaccccccccccccgacacacacacacaacaatatgcccttggtgagaaaatatggaggaacaagggaaatgggatatgatcaagaaccacgaggacatatctttgaaaataaagaactagaaaaaaattccagagaaaatgtttacccagaagacttatacgaaaagtgaacctacaaaagaatagcttcaataaatgcggtattctgtgagatgaggaagaatatcaagaaaaactaaattgctttcatagcgttaaaattgcatcggaggagtaagaaacagcactgatactgtggaaaaaagcattgatatagaggacaaccccaagatacttattccagaagcagaggaaacacagaggttaagatgatgagaaaagggttgatgatgagagaatagaaaattcaaggtttatttaggtgttcattgtggagaaattggaggatgtaggatcaaagacaaatggagaaaaatttgatgagctaaaaattatctatgtggattaaaaggactaatgctattccagccacataatgagaggcttgtatctaaatatatcctgttgaaatttttacatttcgtggatgaagaaaattttgaaatgtcctggatgaaaaacaagttacttctagatttccttttatcgacattaaataacaggagacagtgggagaatacttgaaattgtgatggaaaaaacattgtttttcactcaaggagtttcacctacagtcaaaggcaatggaaatatattctttattactcatggtatcaaaaaatagagttcctcattttatttgcaaaaatgttacttgaatacctattctgactggcaatgtgatgactcaataaaaaaattaagaacaggaaagtataaccataaatatatgaataaaaatatagatagagactaatcatgagaatagtaacaattaaggtgagaattatgaccaagtaattgttataaataagatgacagacataaatgtcaatgtaaaagattgttcttgaatatatgtaaacaagaatgtggttaacaatctgggtccaaaattttagactgcatttttaaattttagtgaaatacgcgtaacattaaatttgtcatcttaaccatttttaagtgtacaatacagtagtgtgaaatgtattcacgtcattgtgcaaccaacctccagaaacttttcatcttgcaaaactgaaactcaatacctgttaaataacagctctccattccctactctccccagcccctggcaaccaccatgtgactttgtttctatgagtttgactaccctagatagttcatgtaagtggaattatacagtatttgtctttttgtgactggcttttttccagattacatttttaagggctgcaaagaggaggaggctggggaggttgggaaaataggaatgacagactagtgttccccttttagaataatttattgttgaattttgctgaagagtctgtattatttgctttgtctctatttgtgcttagatttattattaggtaagcctgcctcttggtgtcaagtacattttcagcatcttgatatggtcatatgactttttcctctatcgtaatgatagcttttctcatagtgagctgcactcattcatggaataaaccctgattataatagtgtattgttcttttgataatattgctgtattcaatttcatattttatttaggcatcttgaagtcacatttacttgtgtgcttgatctttcattggttggttcattgttttgtttcgatgagagaggctacaaatttaggtattcaagttttgctggcctcatagaggcttataagaaagtgttcttcatgaggaagcttgtcttatttcctaaggcctgggagagtgtaaataacattggaacctaaagactagataaaggatacataaaatccagctgtgcactcgcctggacctggtgctgttttcaaaggtggttcttactcacatttctagtatgttctaggattgtcaaatttttaagtacacttatgaatcacctgcagatctcattaagctgtggattctgattctgagggtctggggtagagcctattcttcttcacttctaataagctccccagttatgccagtgctagtggctctggaaccacattctgaatgtggtgtcatagtgattcccaaactttgctgtacatttgaatcacttgggggaacttttaaaagagttctcatgtccaggtctcaccccatatcaattaaatcagaatagctggggttggaagccaaacataaactgctttcaagaatcccagatggttccagtgttcagcaaatttggcaaccactacactaggataatcggtccactcaggttttacacttctctgctcaattttggttacttttagtttactaatacttgcccatttaagttttgaaagttgtagtcaataagttgtatgtattattctctcataattgttttaatgtatttgatttctatggttatgtcttctttttatatttgtatgtcatgtaccacatcatgataggtcagtcgaagacagattacatatggcagtggtcccataagattataatatttttatggtacctttgctatgttcagatatgtttagatacacacataccattgtcttaaaatcccctacggtatcagtacagtagtatgctatacaggtttgtagcctaggagctatatgcaatttcatgcatatagcctaggtgtgtagtaggttataccatctaggtttgtgtaagtacactctgtgatgttcatacaaccatgaaattgcctattaacacatttctcagaatgtgtccctgccgttaagccattcatgactatacttgtatatttttactttctctttttcccttaatcaggcatggaagtggtttttctgtcttgttggtctttttagagaatcatttgttttatttatttttttaaatatttctttttttctattctgttaatttcagcttttatgtttaatttcatctttttaatttttggggtggttgtgatgctgttctttcttttatggtaagtaatgggtttctttctttcttctttttcttttcattgctttttagatagtttataatttcccttttgatttttctctttggttcatggtttattttcttaatttctaggtagttgagataattcagtcatttttttgttatttacttttatttgccaaagatgagacagtatggccttaaaagtctgtacttttagggatttgttaaagttgcctctttggtcaaaaacatgatcgatgtttttagaagttccatgaacatatcagtaaaatataatttgtatttgaatgatatgaagttagtctttgtctaacagtcatgttcaattcttaaaaagatacattaatagtaaaaattctcactgtgactttattttttataaagtttcttgtattttaatagattgtattcataatattttttggtgcatgtggggtttatgatttatcttctttattaattgtgccttttatccatttataattatctttgttgtaattcagcttaagttttctcttaaccgttgctgatactgcttcctttttgtttgaatttgcctgatttctctttgcctacccatttatttacaactttttgttctctttattatcattttgtgttaggtgtgtttcttgaaaacagttggattttgtatttttcagttgacctaaactccctttatgggaaaattcagtccgtatacatttattgtagtgatttatgtattttattttatcccttatattttacttcatattattatatatttttacatcctattttcttatttttgctgccttgattgcattcttatttattgtgttttcttttctctttgctaatttggaaattctactttttcttttcctgctcttgagatgtctgctttactattacttgaaaagattatgcaatttttgcatctactcataggtagtatgattattacctatattttagggaagagaaatgtgaggtgtagaagagttagacagcttgccttaggtttacatagtaaatggtgatagtcttgccccagggctgcctttttagctagtatgctttaacaccgttggagagaggcataccttccacatccattaaaaagataagagggcatacatttaattttattatgccataaaaataaacatagcccacttagtaaactgtaaaataacggtgctaataaatttataaatctgaaaaattgaatttttttggaaaatatataataaaatttatctcaacattagaaagcaaaagtagaatagtattcacgattcagagttatctaagagtcttctctgcaacagattcaaggaagatgatattactagtaaagttttccaaacattcaataactttttatgaaataatattttgttttgttccagagcataaaacatattgggacaatgatcaaaaccattttatgaagcatgtgtatactcctggtataaaaacttgacaaataaaatacaaaaatttccataaaagctttccagctacctgtagaaatattagaagaaactgagccaaccagttcaacagtaaatttaagaactgtcttccatggatgagcaaagataattaaatctacgaattcagtaatatataacaccaataaatgctgttagaaaaaaaccggagaatctctactaatgccaaaaaagaatttgataatattcaatagccattctcgtcagaaaactttttaaaaatctgagaaaactaggaataagtgagtactttttcagataatgagaaaaaaaaatcagtgataaattcatagccaacattttcattgtgaaactgtagatgcaatctcattgatattaggaaaaaaatttcctgctagcacaatttctattttatatatttttaatgtttgtgtatttatgaatgttctgatttttaaaatgttttgtttcttaatgttctggtgaaagaaatatgctcatatatctgaaatgagtccattttattaaaatgaaataaatgaaagttgtaacattaatgtaatgaccttttttctctatcaacttgccacaattaaaaacaaatccctactaatatgtaagtctggcagcaggactgtgagatggacatgctcacagcttgccctaaggagtgtaagttggcaaaacaactttgtggaaagctgcttgacagtttttaccaagagttttaaaagagtttatgtcctttgaccctgtaattctaattctgggaactccagcctaaggaaatcatgagaatggctgacaaagatttgtgtatgaggatgttaattacagtgctatttgtttattatattttaaaaattgggaaataacctaaaatgccaaacagtggaatggttaatataaagtatgatacagccatgcaatatatagtcataaagatcatgcttttgaaaaactttatctaaaaggacagatacaatgttaataggaaaaaagctggatacaactatatttaaatttgatattgattttataaataaatatatatatatatgcggaaaaagtttaaaggactggaaggaaatattgaaaaaaatataatgctatcagggcgtgttaaagttgggaaatttctgactccctccaagatcacctaaatcatcctcgtgggtttacgtttcatattgagagatacacttaattctaaattaatatttgaatgttaacctgggctataggctgagatttaatctctgtgaagaaaatcaccgtctttgcaatgattaatatttctattttataatcacagtttcagctttaacttcaacacaagtttagctttaaccatggatagttcaagtcagttgagaaactgaagatagaactatgtcctgtaacatcactaccagaaaattaccaatgggttagttgtggtatctgaagttatatgaagattggcaaagagctagtataaagtaatctcttcttgtccctttacaaaaagaattaagccttcttttaaactctgttgaagaaagtgaacaattgcaatcatagggctggaaaatgcctatagatgtcttatgtccacctgtttgttctccaaatgaacaatgccagaaaactaacataggaaaacatctgtgtaagaagggagaatctgtgggttgcagtggcttttgagatgctttcttctttttttctgtttttttttttttttttttttgagatttccttcacaaagcaagaatttttatatccagtgggagtctttatagccactgagaaactatctctgtaagatgaaagtttcctcatctgtaaaatggcaacaccaataatatgacatattttataagataatggtgaacgtgaagttaatgcctgcttgtgaaggtcatcacagttgttgggaatatattggttatgctacctttgcaaaatttcacatgcctttttaggcctgttcccattggatgacaaatctgtttattgagccaaaaaacagctcctggaactatgcagaataagtcaaatccaccatctacattaatagtccttcgaatacttgaagacggctttcatgaatttaataactgctttctgtggcttctttttttttaatttcaagaatagaacacagtagactgtaaaaatgagcattatcagtcttcctttggattttctatgtaaatgttgtttaacattcaaatggtactgattataatttgagatattaacagttagatatgccattgtgtccctctgttattgtttgtaaaggaggttaaacagtatattaacttctgagtagtgatttactgttgcttttgtcagagaaaaataaaaaagaagtaaaataatataatttgatattgcctttgagacttttcagtttgtagaagtctttatttcctactcaattttattttttttaaaaagcacacatgtagtgtaaatacagcatcacacaaatgcagagttgttcttttcttcctggattaagctgttgtgtaatattgctctgtaaccattaagcagctgctctgcctcagagatgctcatatttcctttggtagacgaagggaatttactatatgaatgtctccaaattgctttaagatctttagctgttgtattagctatttagatttacagtggtctatgaaatgtgaaaaacatgttcctgaaaggcccaaggaccttggaggttacagatggggttatgttagcagcagataacctgacattttgctgagtttcaccccctatcctactgcaggacccctgcccatttcaaaatcctctcagttattttgctacagccctcaagtattgtcttctgtatgctaatgagtaagcactagtaggtatccaagtactattttaagtatctgagtactatttcatccatgatttctttttcactctgccacgtcttggttaatgcctgtccgttacaaaggctatgctgcctgcagagatgcatgaaggtggcagccatctgcttccggtgcttctcccaggctaccccacttggctgattctcacctgtccctgttcccataggtacatggttaataggcatcatcactcatcctcaggaaaccttcctccactaaagtctcactgggctccatgcaggagtagagcccagtgggacctctgtggttttttgcattttatccagtaggttccaaagaagttctgatatatttccaatgcttttcatggtttcggtaaactacctctttccattgtttccgtagattccaatttcttagaacctgggaagttgggggtggggagtggagaaacaccctgctacattctgaattgtcttctttttttctgtgaatagctgcaatagtcattgtattgtctgtgtttgactgcctgactgtcttcccactggtagaattggccttgagctgactcatcccttcttcatgatttggcttccaacaggctcacaccccactccatcttaatggtcatgacttaggagcagatggatctctgacttctcattggagtaataaggaaatgaacttcagattacacatagatattgtaatgttattttgtattacctctgatatagtttatgtaaatacattgaaatgttcatcacttattcatcgatgtgtttcacaaatatttttgggctcttactatttaaacacttccagttctttggttgttactttgtattaaatgcttgacattacacattagtacacaacaaagtaagagatacaatccgaccctaatcattactctttctcatgtgacccaaaagcctaaatacactcttcagcaaacaagttctagggaataacagaggttagtataattatccataaatcttaaaccatctgtatctacattgtaataaaatgactaagatgttaatgtgtgaccctgtttgtaaagttgaattttaaaattttgttctgtgtttatttagtacttactctatatataggcaacgagttagtcattaaggaagatatagagatgaacaaaacccagtcacttctgtaaataaaggatctgataatccagcaatgactgcaagacttgaaaacagatctctcagaaaatctgaaagtacaaagtataaaattagtacaaactaggtgctatacaagtacagaggaaggagatttctggctgggccagtgggtggtagaaggagttggaggagcagtttacagagtgggtggtggttgggctggattttgaaggatgagactagagtgtgtagaaagagggccatctcatctcagggagctgcaggaggaagatatgaagggtaggcatttacaaagtacaattgggtgatgaaaaataatcttgtgtgactggttaagtatatgagctgtagtcatgataaaggaggttgttttgtttttttgttttgttttgttttttttttttttttgagatggagtcttgttctgtcgcccagactggaatgcaatggctccatctcggctcactacaacctctgccttccgggttcaagtgattctcctgcctcggcctcccgagtagctgagactacaggtgcccgccaccatgcccggctaatttttgtatttttagtggagatggggtttcaccatattggccaggctggtctcaaactcctgatcttgtgatccacccacctcggcctcccaagataaagaaggttttgtacttaatatatttactttattaagtttaccctatataaaataaagtataatgaactataaacaataacaaaagcaacaaaaatctttctatatgatagtaagttacagtggtccagaagagtcaaaacatctctttccccgaccaggcaagacagtcagtgtccttttttgtattcatgacttttagcaccttgtacagtgattgttacttagaagtttctcaataattactgaaatgaatttaacctggtaaaaattaattgctcaagaaataagagtttcttaaaatagaagtgcattaaattgggacattttgttataatactcttaaaaatgtatatatatttttcagaataatgacttaatgtggcacctgttttattccctactgagatcttacaacttcctctcactccttctttcattctgtttctaaagaaggtgggtgggtggatgtcaaacatcagtggctcctcagttcacagcagtgaaacacatatgctaattgaatgattttctgtcttttcatgctatgtatggttgaaaagcagtgtggtgccttttgttctggtaaattttctgaataaagatttgcggatcattttggactgtctggaggccagtgtgcgtaattcggtatatagctgatcgcaggttccactggccctaagatcttaatttgttggtaacatgcttatcatggggtttatatttttatctccagtagtaacaactctataagataggtgatttttattgtctccaatttgttaagtgaggaatctgaggcaaaaagaggactaataacctagccaagatttcataactggtcatctgtggctaggattcaaatcccagctctttgatttcagtgctccatgttgctgcactacccatgcttcacatctctgaactgcatctaattccttggtcagccctgaagctttatgtaaaatccagtcaaattgccagttcttagaatctagttttgtttgtttgtttctcagatgtatttcaattctgaggattttcaaacttattctcaccctaggacagaagcaagtaggccataacctcccctgctaaggtattcctcacactcattacacccccttaacatagatgagaatggggtgggctgggtgcagggttactgttgtttgtgggagttctcatctctagttttggacatagaccagctagcaagcaggctccatggccactgtggaccctgccccggtgtgacttaagggtcatgtggcattcccagaggcctggattcaccaccatttgccagaaaagttgtctaattcttgaaataaaaggagtccagtggaatagtagcaagggtgaggaaagcagtgaaatcgtgcaacgtatattaaagatgcccagaaataggtcaacgcaaagttctgtatttgctgtatatacaagttctgctttttatgttattagtgaccctggaacaagggtcggggtgctggtaacagcagttcacttttctttcatcagagaagggtttacaaaagaacggtggctttaagagatctttgacattattccagcaaggtgctaattgtggttgtggtttcctttttctttctttcatttttcgctttagtctaccaggtgctaccgagtcaaaagcattcactgagagcccacagaccattctgtatgcatgggccatggcaaatcaaaccgcatcaataaacctgtacttttagaaagggaagaaaaaattttcctaagagattatttggtatctaaactttttatttttgtttaaacaaacctaatttgcattcctaagagtcattttttaaagtccttattgtaagcatatttggtttttgttcaaaccattggctttaaaacacttaaattctagtgtataatcatttattttactttctgcttatattgatcatttttcctttaatatttattttcaggttaccttgaggatagttttgtaaaatctggagtcttcaatgtatcagaacttgtaagagtatccagaagtaagtaaattgttttgttactacttaagcatgcagtatgatttaaaatactttgtattttgaaccttaaatgtagtataaagagtgaccacatattaggaaaatttgaattaaaatcttaaaacctttgatgaaataacaatatattttgcttgattttctaaaatgtttgcattcaaatcatcaaaactttttgttgtacaaaaataattttggggtttttctgattgccatgttattggtattcatttaattcactgttctctgcatgaccatagatggccatttatatcaaaggaagtgtgattaattaaatgtactctatgttgttatgataacccacataagtttcctgtagataagtgctttttcattttactaacattttggtgggggttggagatgcacaggatatacacactaacgtgcagagtgtagagggatgcagaaattaactttgcagattgtagttggatatagatagaaagcattgttatccaaaacaatgtccaattgttttaactggccacttcacctgagacaccattcttagcaggctggatcagatttttctaggctaagctcacctggcaggctacctaagcaaaggggacgttaccttgattaactcttttacttattactagcatgtacaaacatatccaagatgcagatctatatgtactaattatgttaaagaaggtgactcctttcttcatactcccttcactgatttagcttatttatgtaactttgaagggtatattttcacctgacattttgatagaatgcatcacacttcggagtgatgttattcagatgatgtagtcacactctgatacctgcctaagttgtgtttctcatttgggtcatatttagaggtcatgaataagaattatgatgatccagaaagaacaaagagtaatcgagttactgaggataagaataagcagtgttttagagtcttgttgttcagtaaaggaatcttcacgctatcactgactgtcttttgaaccgtagttcctcaaatagctcacatttctaaagtgaacagtgcaaatagcatgtatagcagggagtgatacatatgaacgtttaagatcttaagtagtttatcctttctggtataattctagagtggataaatgtatgcccaaaagacttctctcatgggtctttttacatggtggcagtgtaggagaagaaacacaaatatcctgtattctggtagccccagggtgtgtattcgatgggcaaggagattgtccaaggcagtgtaccttaatgtgtttttccagatcaatatgtgatatccaaaggtatccaacatttgaaagttttcacttttaatttgggaagaaatatgcctgacttaccagtagcactttgtagcatcaggtaagacaggggttatctgaaggggtgtgtgtgtcttccccatactcttctttagcggaaaggcttatggtgctccagttaggaggcttattaaattatttgcttaaatttgtacttctctgagttcaagttcaatggtatattttcatccttcttaggagtagggcagtagagtcagctgtcagaaaatatttatttagtacctcatgataggtaatattatgctaagggctgtcaaaggagaaccacattagaaccttcaaaagcccagatagatattttgaaaaatctgaatttcaaacattaaaacaaagatgaaaattatctttctagaacagttcaaaaccaaggtaaatttaatatacttcattcattcattcttaacttataatgtcatatcctagaaacttttaggttatttgttataacaaacattactgatttgtaattagcacattaattatctatattcattacgtaatttattcagcaaacatttattttctcctccatatgtaaataggtgtctctgaaaggcctgataagttctcctcctaagtgttttaatatatccgcatcataatctttgtttacacaattaaacttcattatttatgaaataggggtttgctaagtaaacataaacttcagcacaacactatgtgtgtatcacaaattctgacttcttgagggtttacagtatgctagtgctttcagtcctctagggttttacaatcataagacccactgatgtgtatgttgactttagctaatgaagccattcagcattaggatagtgatctctcttttgaatgatattatctccatcttaaaagttgatttaggatcagcttttggagtgaggagaacaataagggagattaaaggttggcctctaacccttagaatctgaggttctttggtgcttcatttctaagaggatatcggcatcctcttaaacatgatttgcagctttcagccttcttgtagctccctgggagaggcgctaacactgatctttgcgtctgatgtaagttcttccagaggctcttaagcaggaatatctgactgagacttgctgttcccacacactctgtcattaaataatttccatgtgtgttgttttagtactttggccgtgtttgttaatctactttcctttctgtatctcccatttagtgtcagaatgcatactaaatttttacagtgctcatgcataaatccgtagacaaattattttattgctatctttacaaaattaaaacataatatgtgtacatatttatggaatccatgtgatctctggatccatgcatacagtgtataatgattaaatcaggctatttaggatatctgtcatctcaaacatttatcatttcttcatgttgggaatgtttcaaatcttctttttttgctattttaaaatatgtaatatattgttgttaactgtagccaccctgctgtgctatcaaatactggaaattattctttctgtctattataactgtatgtttttacccattaaccaatctctcttcatctcctcacctccccaccctcccccacctctgacaaccccttcgatgagatcaactttttaagctcccatgtatgagtgagaacatgctatatttgtcgtttttattgctgtcttgacactgcggaataatctttctggaacaaaatttagaaaaaaacaatttctgaagattttaaaattatcatttactacaaattacatctagtttatttatgggtaagcaaattatgttaactatggagccatatgtattcaatagaaactataaatctttgcctaaatattgcatgagcttaataaattgaaaatagtttatgtaaggtggaacctctaagtttcctgttaataactcaggtctatgaattgtatccattactgtgataggaagccagacagattgtttacttcacttgagcccctgaaatactccttctagcatgtaccccactgccagtgtcatatagaacatggttctaataataaattataaaacatgcggttactgtgggatttcttacctcacatttttttaacctttggtgtgcctcaagccacaacagacatagctacattttagctgtccaaataattcaagccatcaggcacttagttactcattggatacaagtattttctgtgtaaaggatgttacagtgtattatataacatgaacaatctatcagaaggctgatagataatccagaagtttggagctgttactagtcatgtatatactgatgtatttaatttttagtccagaaagggagatgttcattgtgtattccgtggttacttctctgtgataaagcttgtacctcctaatcatactttcttaaaaatattttaagttaatcttagcctgcctaatattaaaatacaattcaaagggtagtgaacacatttagaatattcattaaaaatgaggggtaagaaaacttccataaaaatctgcaatccctttggaattttatactcaacttgaggcagatgggagagaggaggagtttaagtagaccacgtatgcttagagtgcatctcaggggctctagaattttgttgcaaagccccagagtacaatttcgtgtgagcttttgaagggctgattaagacaggtaaagaaatggaaactattcttaaggagttctttgacaccaacctgcctggtctccactttgcacattatctctacctatgattttgcttctgcagcagtccctgtttagaatgacctccctctaatctcttactcattctccagagtccagtgccagctatggcttttcgcagacttcttggacaattcaagctggtattggattctttttcccttgaaattctacagcagttttggatcatgtcattaatttggacagtttcattttcatctattttggtatttatgtgtttcgcatgaatgttttacttacccagcttgttgcccaatatttttattaagggcaatatatgagactattttgtacacattgcagccaacacctgccagcagtggacacagtcagtaatttgttgaatgaacaaattttcagcgaacaggttcatttatacctcttcctctgcttttaacacgtttttgaactgttcatctttgctaaccattccagtctaccagggaagaagtttggaggagaaagcaaagaaggaagggaactcacaatggttgagcacgtgttatacactaggcatgattctaggctcttatcactacctatttcatttcatcctcaaaataatcctatgtgtccggttattattactcccattttacagttaggaaactagggcacataacttataatacagagggagtttaaactaaaaggctatttatctctcaagactctgctgattctaacacaatatgctgcctcacagctttgttcatgatatctaaaattaaatttaaaaaatgtgaacagatgtaattatacaaaatatcatgagatattttgataaagacatacaatgcataataatcacatcagggtaaatggggtatccatcacctgaagcatttatcctttgtgttacaaaccaaaaattattattctatattatcaacattaatatcaacattaatatttgagtggattagaagtcatgatattaataattattatcatatcctaactgggaggctgtgaataatgatttttgcttttttttgtgaaacggttctctgtttatttatttaacaatgatttggttttcgagagcctaggtagtgcaaagcagcttgtttggtgttgctgagtgataggactcgtatattctgtttcctccaaggcatttttaactagcagagtgacagatgtaatgtcaactaatataaaggagtgagtaaagaaggttgaggaataggattcgggaaattggtaaccagtgattataatctgattgcctcaaatttccaagcttgaacgttgctaaggtgagcaagttttcaggtcctacccaggttgtatggtgggtattagaggcttaaggtgaagaaagttctctctatctttgaccagaggcatgaaagattctcgattattacatttgaatagaggtcagaaatacgaatgtcattcccagtgcttctttgtcttattcctcagcgcccataacccagggaactggagtcaacttcccaattggagaaatcccaagccaaccatactatcatgacatgaactcgggggtcaatcttcagaggtctctgtcttctccaccaagcaggtactgaaagaagggctgctcatattctcaagtgatacacacataggttcgtaggtggatgataggcagatagataggtaggtaggtaaagagagatgggaaataatttttgctggtagtacacagatttttaatctttcctggttaaatttatttggctgttacaaattaaatgtaattgttgtacacagcagttttaaaaatctttttcagggggacaggtaactaggaaaatatattaatatgacttttgtcctgttgtaggaaatattaaaatgctacaagttaacaaaatcttttgatggctttaaaaatgatgttgctgtggcaatgatctctggtttataactgattcctggtaacttttacccaaatattacatctaagcttaggataatgaaacataaaaaataaaatgtgtcatttacctagccttaaaattaaagaccacagtttgccaagttcttcaattagttgatgttttttgactaatttaattaacgctctgttaccaatgaaaatactaccttccctgagatttggtttaaccattctatgttgggggtcagctagagagagttctctttgctttttacttctctgttaacattctcattttttttttcctgatcttctcattgtaattgccagtcagggtgaataaagattacagatgtgttaatttttttttatttgagctagatcttcaagacccatctcattcctagagcattaaatatatgtgtaatcaaatataagagcatacatgaattctagagcaaaacactcattttacaatgtcaactttttaaaaataaaaggatacctgtatatttatttttctaaagtattctcagtagtgaaagttcgttgaatttgaattaattatggactgggcatgtgtatgtttataaactaagatcaattttatatcagttccggttaaaccattttcatatagttaaattgtgtagcaagataatttggtttattattaaaatagtctctgacatatcaaagtcttagaaatgctttgatttttctaaatttaaaatgtgagcagtaatttttaaattctgtctgctaaatcactgttgtcaacacagatctttcttcctgactactttatataagatactgtctttcagagtaagcaaggtttaaaaaacatttctctagtacttccttatgcatgtaatttgtccccaattttaagtttttcaggcagattttctgctgactcatagatgagagaatatgtttaaaagagagttaaaatgtaaggtctaactttggattctttgggaagaaactaagcttagcatggatagaaattgccatcttctacatcgttaatactctgagaattgtgagtcaaatattaatcatgagtatctacaaatgtactcaggcatatacatgattcaagggcttggaaacacagtgcagtggaaagagcacacttgcggaagtcagacgtccttaccttatgtctgactgcttccattaacttgccctggacagtccactgaatctctccaaatgtgtctccccatttgtaaaaacaaggggattggtttatgtatatgatttttgaggtcaatttcaatgctgaaatcctataacattatggttattattgctgcgaaaagtgaattttgaagatttttaaaaaggttttaccagcataggtgtgaataagattttttttttaattaaagaaaaaatattcactgggcacagtgactcacagctggattcccagtactttgggaggcccaggcaggaggatcacttgaacctaggagttcaagaccagcctggacaactccctctctacaaaaaatttttttaattagcaaggcttggtggcatgtgtgtgtgatcctaactatttgggcggctgtggtaggaggatcacttgagcccaggagcttgaggctgcagtgagctgtggtcatgcaactgcactccagcctggacaacagagtgagaccctgtctcaaaaacaaacaaacaaaaaaagaaaagaattcacttttatagtcataatttcataattgtctgctttattggtgggggcatatgaaagaagtatatcaaccactatgggtataaaatagcttcttaatctttgttctggatagtcacctttcttattcattgagatgagtcatatttccatattaaaatgtatcattttggctgagcacagtggctcctgcctgtaatcccagcactttgggaggctgaagtgggaggatcgcttgagtccaggaattcaacaccagccagggcaaaatagcaaaaccccatctctacaaaaaatactaaaatcagctgggtgtggtgacaggcacctatagttcaagctacttgggaggctgaggtgggaggattgtttgagcctgggaggtggagtttgctgtgagccaagattgagccacagtgtactacatcgtaggtgaaagagtgagacccagtctcaaaaaaaaaaaaaaaaaaaaaagtatcattttaaaagtttgaatttggcagtggccttctttttttcacagtcgattttaagaataaagaatcaataatctaagttttaagaaaaagtaaagaataatatatgaaatagtttataatcagtaaaatactataattttttattattaatgatagggttattactaagaattactatttgataagtatcttctaaatgccagccacttaactaaaagctttacatttaacaactcattttactcttccaaccgtctgcctttgaactaggttttattgtttccaatttacagatgattaaactgagtttagataagttaaggagcttactattaacaattcataagtggcctactcaagattttatactaggactgtcttgactccaaagctcttgttttactttattaccttatctttggattgcattgtcaatgacaagtgctattaaaaggaacattgttagtattgataataataatgagtcaggtacacaataacacaattttaatgttagaaggcaaacaacattaagagttcactttttattagtggaattttttttggaaatacatttgaaagataaatataatgaacaccatatttgttagacaggttaggtataagatggtctaataaatggtatatgcaactagaaatatttgctattactattgatatcttcaatactcaccattatactcaccattattacttgtgcttatgaaaattttcacagtaaggatcttctcagatcatttactttaaaatgtacacatcttcccagaaatcccattaatataactattgccatattttaacagcaaaagacccaaaactatatccatagatgaaaatatggaaccaagtcctacaggagacttttacccctctccaagttcaccagctgctggaagtcgaacatggcacgaaagagatcaaggtgagtaataaggagatgcctctagagaccatgagtaaaatgttggctcgtttcttaagtttcgttgagtcaaaatttcataattaaaccaatatggattgtatatttttttcataaaatgattcctgtagaattatttttgagataatgttagtcaaatgtcgtcaaagttaatttatccaaaatcttatttttacatgtttcgttggagttttttttagacaaaatgatattttagaacccacaattatgtatgtgactgattatggtctgtctacatttgttggttggagtacagcagaaccacaaactgtgattcaattagatccgcctgctcctctctatggagcgttgcagggagccaaactttaagcagtttgcaagtgccaggaactgaaagttgtcatttaaaggaacctgcaattccttttggaagtaggtagaccatatacaataaagaaaagtgtaatgtaagatactttgtgttggagtcaatctagctatgctttctagataaaactgtgacccagttctagggcagctttgaggagaaatataactttaagaaatgggtattgagacccggaaggattgagacttagctcttcttaaagtctgttggatttactatatttcattagatatatccatgctttcccccacaatcagagggagattattaagcatggaaatagaaaaattagctaactgaagtttttgttggtatgtaagcatgtctgcaaataagatcttaatgtcagcagcataaacatgtatttttaaattgtcttttaaatagaattctgcattaaaaaaaatctagcctgggcaatgtggcaagaccccatctctacaaaaaaaaaataaaacgtaagccaagcatagtggtgtgcgcctgtagtctcagctactcaggaggctgaggtgggaggatcagttgagcctgggaagcagaggatggagtaagctgtgatcacaccactgtactctagcctgggtaacagagtgagaccctgtctcaaaaaaaaaaaaaaaaagtctaaaagaaaggaataatggttttcagcccaggacttgggtgtgtattggtgagggttggggtactctatgttgagtactcttaggagacacataactctgggccttaacagttaaggccaaagtcagttctttattcagtgctccttctttgctgctcaaattttttataccgagtgccatggagtttaaagaatagtgaaaaatcttcatggagacattggcctttgagtcaagtgtacctcctttagcacaactgactcaaagctcgattcctaaatctcatctaaatctccttgagattttaactagtaaagaagtgaggggctgaagagggtggtggtgggaactgagacaaaagcataaccctgtgttaggtggggaggcaaatttgagaatggctgtgtgtgccatgtggctggacacagtgcacatggagggaaataatagagatggcaagggtcattttatgcaaggatatgaaactcaactggagagttttgactgtgagacccccccctcagacggaattttgtctctgagactcccctcatgagagaccccaccaaatctatttttcaggcagtaggtaaaaatcatctttataaaatgtaaataacagcattttattcccctacttcagatcctttagtcaattcccactgctctcaggaaaaaatgggaatcttttcatatcaccaacaggccatagccttggcaggtgacattctgcttcctcttgcttgcacttgagcccactgctttacttgaagttgcgaattcaacaaccgggaccttcctataagttatgacctctggaatgctctgctaactcttcatctggcaaactctttgccatccttcagagcccagcttaaactgagaaatttcagtctaaattctgtcttcctagttttctctgtcaacacccagtactgttctttcattgtactcataatatgtaatcatatagctatttatgggattagttgtctaaatctgtctacactgtgagagaagggaccttgtctattttgactattactgtaaccagcacttaacacacacttggtgcgtagtaggagtacaataagtagttgtataaatgaaccattgataggcagaacaccagtctcattagtgaaggcaagatataatagagacttttaccagagttgcagaagtgaaacgaaaaacaaaaccctcaaccctttatattttattgcttgttttactgacattgtcagcttattctaaacaaagccatactttccttgtcagaaaattcttctggagaagattttaatggtaataaccttgtgaatgtgtgggaatggatgcgttattcagaagtgtaggtgttctttattatagagagtgtcactttgtaagaattgattcctctttaagcctactgaataaagccaatctcaaatcatattatgaaacatttttgaaaagtagaagggaaactgtcattctttttctttgtgaaaacattgtattgtcttggtgattttcttttgtcaagatgactagacttattggaggagtctgtaaaggcatattatgtttagaggaaggaagaatattccattctcaaatgtgcattttaacacacacacacacacacacacacacacacacacacacacacactctgtcactttaattctgaagaccctgaagacttcgtaatgtgcacaataagccattgtgggaagaagactcaactacaatgaagaaatgcgggcagtacagtactatctttataaatttgctaagcccaatgcagtccttttgttcttagaaaattgctttttaaaaatttgcaaaataaaatgcccaatggttgttcttgtccatcttctaatgttctttagacacacttccctgtgatggagggagttgtctaaagcacatattgagtgccactccagtcattgaaatagctttgacatgtcttgtatttataatattttctcctacaaagccctgcactaattgatactcaataactatttattggttaattaaaatatgcttgtgtttaaaatgggcagaaatccttaaaatttactattaattatttcctgggtatgccttattctgttagtgttaaatttgcattaaaatctgttcttgacatagcccttagcaaaattgatttattaaatatgagaatcaaagataacaaaattatggacaatatgtggcattctgctttccctttcaatctgaaataccaacctaaaccattgagatttattctgagtaggcaaaaataaaggatataatatgaccaaattattatatgtattctgttcttaaaataaatcaggcaaaatattaacacaaaatctaggtttatgtaataatatgttcatgcaattttagtaacttaatgaaaaagtatttttagcatattacaataataaattaattatgtccttatgtaatttcttttcaaaacaaaaagttacaacttcctgattataagagaattgtaatttatacttctgcaaatatagacatgaatattttaaaactaaccataatttaatagtgttaagcatttggtagggggctatataatttgcttcttctgatgaatagtgatgaaaattaaatttgtcagcatctatattatgtagtatttatatttttactttgtattattttatatatacagaacaaaatgaaaaggaaaataatactgagtcactagcaaaggggtatccaacaactgttatatttctttcctatgtttcagaatatttctccttgcttagtctcttctgtaaatcctggtcttaaactcctgactgcttctctctctattaaaaactttcttttttggatattgcttttcttcatttaagattttaatgattaatgaatagaaccagattagactgtcaacaggcaagttgaacatttcttttattccaatacttcctccataaaaaattccattaagatcttgtctttcttatttttttttccatctgagtcaattcagagactcaatttctagttgatgtactttttttgaaatttttctttagagcaatcttttgtaacttttgatataagaggaaaaataagaggtcatagtttttcgtctaattcaagttactctcatgagactaaatccagttgtattccgttgctcagtgtgttagtccattttcatgctgctgataaagacctacttgagactgggcaatttacaaaaggaagaggtttattggctgggtaggcttcacagtcatggtggaaggaggagcaagtcacgtcttatatggatggtggcaggcaaagagagagcttgtgcagggaactcctgtttttaaaaccctcagatcttgtgagactcattcactatcacgagaacaacacaggaaagatctgcccccataactcagtctcctcccaccaggttcctcccatgtcacgtgggaattgtgggagttacaattcaagatgagatttgggtggggacacagctaaaccatatcactcagtaatttaacagacaaataaatagtatgcttgaacattgaaaacaattctttataaggtcactttgccactgccattctaatagtcactaatttatctaagtctgaatgtaaaatttctaaaacatttaatagacatttaatgagaaaaaatatgatatgttaaatatatttgcagtatgcagctggggatttcgttgttttttttttttttttttttttttgtgagcagcagcaagatttattgcaaagagtgaaagaacaaagcttccacagtgtggaagggggaccccagcgggttgccctcagctggggatttctaaatggaaatttgaacagcttttcagccagatgagtatttaaacaacctgtaatcttagataaaatataaattcaaaaagactttatgcagtaaaatgttattaatttctacatgtatgggatttgagataatttggttcaatgaacaatttgtcaaatgtctatattatattggaggaatttttataggcattgggtacacaaatatgaataaattaagtttccagcccttgacctcctgaatggaaaagtaacttttactatttagaaaaatcggggactaaaataaataagattatgagagaaccgactccatgctttagagctagcttagttttaaggacgatgagccgtaaatctttacataaaatcaataaattggcatgttagcaaaaactagcactacttggtatattggcatgttattacaatttggagagtagtttgaaaaattaaactggactctcaagctatatttaggcattgtgttctggtgtcttaggtactaaaaaataaaactactaatttttatacaagtctccagttctgttatataaatgtcttctcagttaagtctttctgaaattttaatttgtttccaagtcctagagatttatttttgataattttgaaaatattctcattagtaaggtagtcttaactgttgtgctaaatttcagtttgcactttctagagttctataaggatatagtattaaatgtcaaacgcattaagccagagggcccaagggaacactgggggctagagagtaaaaatgccagtttagtattatgtgctcaatcaggaaataagtaacagtaaataagagtgtgatagcatgctgacagaaccagaatcagaggccagcatttctgttttttctctgtctgttgcccaggatggagtgcagcggcacgatcatggctcactgtagccctgacccccccaggttcaagtgatcctcccacctcagcttcacaggtagctgggactacaggcacttgccaccatgcccagctaatttttaaattttgtgtagagctggggtctcactatgttacccatgctgttctggaactcctgggctcaactgatcctcctacctgggcctcccaaagtgatgggattgcaggtgtgaggcaccacaccaggctccccagcatttcctaatgtgagtttaggaatgtgaaaagatatgctacatacaaaagagtggtcagctaaatttgcaaagtttttttgtaacaaaaatttcaactattttcattcataaatgaatatgcagaatatttaatatgctactgtgtgctgtgaatatccaggagtggctcttgactgaacatgtttattaagtttgtgacttcagaaccttttatttctatcaaagaatccatagggagcattaatcctaggcccaaactttggaacacagtgctctagtccaaaccacagtctgacaaatgatataatctcaagatttctctagagctgtgggagctgagtgaataagcagctgtcatagatggttgaataactgctatctgggagtcattaacattaaatgaagtcctagaaaatggcagtgcagacagcttagtaaccatactggaagaagttttaaagttctctttggggaccaaatagaacaccaacaattccttatattcctgcagttagtatcacagggatgaaatggcaaatattcaaataccaaagttttgaaccagaaaaaaagagagctacaaatgcttttggtggatgaatgtgaagaagagatggtttgaatttgatgttcaagcccaatttttaagtttctttgtttagcttcttattatggaaaatatcaaaagtaaagaactctaagtgaatttctaggtactaccctggcattggaaagcaaacttcaaggatgcttccaccctgaagaggaatgcctcttcaactacactgctacactgctgtaattgaaaaatcacaacacgatcttcttcaaaatggaaaggaaaacaataaattgttggtgaaggctttcatcagaattccccacattgcctcctaattagtgaatgtttgttcccccttcatgtgttctaatcaagaatagcattttggatggggtaaacttgtatacatgttagaagggctggtactgattaatatggaaaagtcgtgctcatatttctgtgctctggaggcttaaagatttgaaaatacagcattttgcagaaaaaccacaatagataattagtttgaaaaaataacaactttctatttaatactgggtttctagcttgatggaacacagcttaaaatagggaagtgggaaacccatgggagataatgtcatagtgtgccatacaaagtttctctgcataagaaaaggttttatttcaaatctttttacatattgagttcatgtttaagcttattgtgaagtagtttggaaagccagtgtcatttgagttattagactcccaatatcatatacaataagaaattgatttttcaggtacagatcacaaattattagaacccttagtaagacataattcaagctcctgtttcacagctaagtagtccaaggatcagagaggctgtcctgtcccaactaatgaatggcagagcctagatctttgttcaagggatttttttcattttctgttatcctgcagcctgcctagggaatcagtatgtaaacttacaaatggcctaggagatttaaacactgcttcgcaagtcttcccagagggacacttttcttggaaagcttaaggaagactctgttagacctaacagaactagaatgagaaaatagaggtgtatttgtgagttttcagggttctgaaagaattctcaaaacaaaattttgagatggtaaaattttacatatacatacacacacacacacacacataaatcaactattattattagtgccaggattaaaattttttcaactaaaataaactgaagatatgaatgcttttgaagaataaatgtggggaagagtttgtttgaaatgaatgtttaagcacaattttaagaagtcttttggcctggagaatattgaaagtagaattgtaaagtgaacctcactgtactgtcacacagcttcaactgttattaacactttgccagtcttattgcatttactatctcccagtttttaaaagtattttaaagcaaatcccagatatctgtcattttgcatgtaaatagatctgaatatttcgaacaatgaactttttttttttacataatcacagtactattatcaatttaacaaatataacattaatttcttaatataatctaacatataatccatgttcaaattccctagaatatctcaaaggttgtcttgtttgaatcaggactcaaatttagtccatagattatatttgtattttcaccttctttttagcctacactgattattcgcctcctttttctgtgttatttatttattgaagaaagcatgtaaatttaaaaattgtcttcaacaagcacatgtaaatgaaacatggaaaacaagattctattgccatttgtggttgtcatttatttattgagcccttcctttctgtcaggtgcttggctaagtttatatctatttttcttttaaacctgacagaaaccccattttacagcttactaaactgatcatgcttaagaaactcatcatagatcatgcagatcataagtagcagaggtagaatgggaacccctggctctcttgctgaagaaacccatgctcgttattgctatataatactgtatcccaaataagtcattgagatattatgtttatgattttgcaaactaattataaaacctctgttacaattttttttaatgcatgaaacttcaatacagatgaatgcacataacttcacaggggttcgtagactccttagagattcatgcatgtagtccttgctctgaaatcaggttaaaatcacttttccatttaataagatagtaataaataatcctaagttctagaatgtctttagtagaagtgtgtgatatatggccagtttaaaatgagctatatttgtcaaaatataaaaataaagtatatatttattatcatacatatgttttcttttagttctgttctagtctttttgccttaagcctagtgcactgtaattgtgattaggaaactctaaatactggtgtggtcttagacaaatcacttaacttcagtaactcttgagttttcccatctgtaaaataacaaagttgtatactaagatttgtgttctaatattttagattttgaatctattggagtccaagaatttgaagatcttcagtacttgagtctttccaaagccgtcattaacatggatcttttggaaaattcagaaagttttctgtttcttaaattattttttgaatgttcattttaaacactctcattgaataacaataattgggctgcttatgtgcttggaggccccgtatattttgctttatacctgaggaatgcgcagttctcacaaatgcatgtcctgtcctgcaccattctggtgcaacaaatgattgatagagattgagttattataacagaaccttgttatggaatcagtgtctcctactttgaaaacaaatgactcagccagacagcaacatttattttctctaaatgactagggatgtagcaatgggagaccattatcctgtgacaatattcggtttcattgacattatctcacaaatgtaattggtccattactaaatagaggttttgttactgatgaatttcacatgatttctaaaaccattaggataataaatatgccatcatagtaatttcattgacagaatgttctttttttcttcatttacatttgttggagaaaaaaaatatagatttaggttgaacttaaacactacaatttataccaattttgactacttttccattaagagcaacagaatattgtgcagagtaatcatatttgcattgagctgctgaactgatgaccttaaaatttttgtaattctttttctaccacactaaatcacatcaaatcataattgttctcaagcaattagtttactacctcagtgtaatgattttatttgaagtaagttccagatcatttataggactttcctgtaaatccactaaagtaacacatcagttaaatcaactctaaccattaccagcgtggataataacagcattagtaacaacaaaaaccttgagatgtcttgtagcataaatgtttttaaatgtatggcttttccccaaatgttctcctctgaaaactcatctgtaatcttgttaaattagagcccttccagtatctttctgacttttacagttaaggttatggtattgattttattttatagcccatggctctcagatgcttaacattaataagactccatagccaagaggttttcccgagaggcatggtgaatagcagctatttacctatgccagtgtttaataagtgacgaaaatatgctccaagtcctgcataattgtttgatgttttttctctctttcaaattaggtttacacacattactcaagaccctttatcattgtctgtctgttaaaatgaaattgcttagtggacaaaagcattttgaagtgtttttaaaaagtagttttcatttattccatattcactgttttagcactgttcttcattattcaaaggatttttttaagtgtctctggaagacatttgtgagcttcaaagaggtttgctttaacttggtattgggtgtaggtgtagcctcgagaccttttttatagcgaagtgataaaattgagacttgtaggaacatgctacttaaccgtgcttgggctaaaatatatggcaagagagacttaaactattagaaaagattttactttactgaggaatacaataatatgctcaagtgtaattaagattaaataactcagtaattaaagtaagaatttcatttatttaacacaaagaccaccatactttctcatttgaaaaggaactgatttcataaatttaaaaaaaatggttgagaaatctaattgaagatgacatcttatctcctcttaacgtagcttgccattttttccagtgttattttagagtgtgataaatgtaaatatatatatataaggagatactttcttaacatggcagctaattattttttgaatcatctggcatcatcatcaaactactgtagtgggattacatccatatgtcttgtcataacattcagagctttttgttaacttggagtgtgtgggaaggacttgttcacatttgccacacaatcataaaattttacatctagaggagtccttagacacagatatttagatattcttttttcttcactgtattttcaaaagacattgttttgcctgtagccaactaaattgcaaatgttacattgaagcatttcattttacagttttgcaatatccagtacctaaactaatatgaagctttccttcttgcagtgtaatgtgggacacctaacaggattcaatattgtcagcccagctttgggaattatttatagtattctgtggagctacaggcaacaattttcccaaaaatatctattttacagtttttacagtaaaagtaatagttatttgtggggaatttgaaaaaacaaactttcaaatatgaagaagaaaataaaaatcacctgtaatctcatcacataaagataacttctgttagtatttcattgtatatatgctagcctgtttttctatgtatttttctgcatttcggtgcgttctatttctatgaatgtatttttgcagtaaattgagcttatatgatatatgctattttgtaagtttttttgtctttataatctaatggcattttaccatatccttcaatttccttttttttttttttttttttttgagacagagtctcgccctgtcacccaggctggagagcagtggcgtgatcttggctcactgccacctccacctccctggttcaagcaactcttcctgccctaacctccccagtagctggtattacagatgcacgccaccatggccagctaatttttgtagttttagtagagatggggattcgccatgttggccaggctggtctcgaactcctgacctcaggtgacttgatccacccgcctcggcctcccaaagtgctgggattacaggcatgagccaccccatccagccttccactttgtaatgagtacataatatgccacactttggctacaccatagaattttaaatatctactttgctgatgaatatttagatagttttggagtttttgtattataaagagagatacagtgaacatcactgcatgtaactctgtgcctaatctgattgggtgattcttgtctagttcttttcactgtcccaagtccctagcatactgcctggcatgaagtcaccaagtagaagttcagtgaaattttgctacgggaataaatacattcctactgtagaattactaagttaaatcttatgtccatttctaaggcttttggtaaatattggcatagatcttatcaatttacattccctagagcagtgcctgagtggcttaactccattgttataagccgtaataatttcaatgtagcacatggctctataagcaatttcaaagcatgtcctctgacagaaatttatagaacattctttatggccctgtgactttacccatgcacctcttttttatcatttgaattttatttaaaccatcaaggaacacaccatgtgtcttctccccatgagccaggatagctccatttgtgaagaaaatggagaaattgagagggtattgtacaaaggattgtacaaagctttcaagtaaaggcagagcctgcttggtctctctctcctttcttcctccttcaggacacacaccctcacccatcatcagtcctttatttattaggtaaaacctgttaaagtaaggattgctgtcattctctacatggagatccttagaaataaatacctcaaagctttggactgggatcttaagtatctggcaggctagatgctgccccaatctggccttaatagttgtcttattctacataacactcatacacttataaataacctggacactttcctctcttcaacactgtttatcccagggcaaaaacagaggcagagaaattgtggtctttttagctttcagttggcagtcatcttctctgccttctccttgtcctctgggaacagagcccaaactgtttccttgtctcaggactgactctggatttgtggcctgaagtaaaaatgtcagatttcagctacaaaactcatcccacacacttgatttggtagcctgtcatttactaccttatttattttaaataacattattatcttatacagatggttcttttctttttcctgttgtcttccagcttccacccaacattttaatggaaagcagaaatatcccagttaagctaaagctcatttttctctttcagtgctgtgttgcttgacagagtttcaatggagtgatggatgtgttgaccacctttgccttcacccagcaatgaatttggtctctgaagaggttttcaatattcagagtttttgtttatctagaaaactctttttaaaaaaatctatgaaagtctaatactttcaaaagtccaaaaaatgaagaactttgaaaattatgagggtgtatcaacttgataaaacttgtcaatataatataatcttgtcaaatcccagccattggactgtctctaagctaagtgtgcttatgtatgttctttccttctctggtctgtatcaaactcctctggtcagtatcataccagagggtcaaagttaacagaagttttgcaactgttttcattacactttgagttttcttctgccaaaaaataacaaaaaaagaagatgaagaaaaaaaggaagaaaggaaaaaagaagaccgtatgcaatgaatcaagcctataatctcaacactttcaaaggccaaggcaggagatctcgtgagactaggagttccagaccagcctgggcaatatagccagactttgtccctactaaaaatttacaaattagctgggtgtgatcgtgtgcccatagtcctagctacttgggaggctgagatgggaggatcgcttgaacccaggagtttgaggctgcagtgagccatgattgtgccactgcagcctgggcaacagagtgagaccttgtctctaaaataattaaataaatttaaataaataaatgaaatttacacaataataaaagatagaaaggaaaaagaggaatcctgtaaattgtttagcagcttgataatgtgaaaaataaagaaaatatgtagatattttaacaatgattatagctttataagcacttagcaataaaacaaaccttaacgttaaatactggagaataaaagtagccagcaaatggtgacttgtctctatagggttcatttagacttgtttacaagttacaagtatggcatgtaaataaggaagacaatttaggaatatgtaaaataattacacttttaaaacattttgaaggaatttacttctttgttaaccagatagaaataggactattctatcctagaaaaaggactaaatcataggactggcatggttaatacattttaatttagtgatatggtttgctgaaaataatagcttccagaaattcaagaattcttgcgtgttcttacataattaatttgaaattgttaaaaattgtgttactatagggaagaaaaggaatttttcaaaaaagaaaattgtatgttttctatgtaggctttagtagtctgatttgtaaccttaatctactcgagcatattggaaaagctaacatattgctctactatatgtgaaaaaggagcaggtgtcccagacaggcaggtgttaaggtgctgtttgagcttgccctagatcactagttgacttcaatgaagttctactaacaggtggctaactgattggagtgccatgtgacatttatcccgggagcgacttggatgacaggctgctacagactgaggaaggggtctttgctttgatgaagaaattgccaaaactcatgtctcattagtgtttcctaaggttctttggaagtgaacaacagtttaattaagggctgacgtaaacacgtttctgcacactttccctgcagcattttatcacattagaattgatcaaaattgttgccttgggctgacttgaacagatatacatctggagcgcaatttgtgcaagctgccgatgagtcgagtacatacgctgtgtttcacagcgactctcttcctttgtagatgaaattaccttgttgggagatgagttgatctaactctttatttgcttaagtccttatctctttgaagtgatgacgtgaaataaataacacatcaaggcctaggatgtatatatgttacagtgccaaaaatatatatagtatggtcaggaaaaatcgtgtgataatttgattttgcaaaatacttatttaaagggatgcttaagaataaatgaaccaactttatcagtagcctacttgaacttttttcttacatggtgatcttttattccatattcaactacacgatgagtttctaaagtcatagctaattttccagttataaatgtaaacatgggtgtacacattgaagaataacaccatcaatgtgaatctttttaaaaaaattattctctctaatctgtcattaagaagaattctttctgcaatccagtattattatgattgcaactatttaatgcatttctgtctttaatttctgccctctctactaaaccatgagcatcaccaagacagggaccacgtggttttgtttggcatcttgatgcatagccatagttcctcacacttactagaatctcagtgattgattttcttttctctttgctttacagtcagctacttctcatctggtgatatttattcatggaacatgaattttaagatatactggctatggttatttttctcatcctgcactactagtcatcacttcataatacagtttctttcacatgccagagattctaaaataagctgcctagacacggtgcctgctttacctcttctttctttcatttctacttttttttttcattctcttcccaagtagcatattcttccagcctctacatctttttgtgtttttggtaaaagcatgttccttaggaggtaagccattagtcacctttttaaaaaaagcatacgcagtggatacaagtaaataacaatgaaaaattcatcaagcaatataagatacaaacaaaagatcattaatgaaatctagatctcagggatttccaagagagattacttaaggagaaaacaagtttgttcagtggataaaacattgttctatgcgtggaataaggagagtggaaatgcctcattttctagttcaagggaatgtcatagatcagggatggcacagagttaaaaacatatttctcctgctcctaatggaagccataagaaaattagcttcactgaagtttaaacaaaatggaataacaaagaaaaagagctatttaaaaatgtgatactgtggtagatcttgcaatgagaaagatactgtttgaaggatacgatgccagctgctggtttttataaagtgccatggagaggaaggcctggaggagactaggaagaaaatttttggttcagccaggtacaagtgaaaagggcggtgagaacagaaaaaaaaagtcaaatttttggaaagttttttcttctaaaatcaattcatttataaattattactttctaaatcaaatttaaattgttctgtctgattttaagccatcactggcctctacttgtttctcttcaactaccagcaactcctgcctccctcccaccagtagaaacatcagctaatcctttgcctatcattttgcatctcttttcagcttctttattttatgtattattcaacttatgcattattatgtatgcattattcaagttattatatatttatgcattattcaactttattattattcaacttattttcaacttaatctttttatgtagtattcttcctgcttgagggacagtagattgtgtaaagcgtggtatttgtttttcttcacagaaaggtcactttaaagtatcttttctatatattcattcttcaaacttttttttgtagcatatgagcacattacacatagaaacaatatcatttttcaccttggcatgaagccttttagactgtagacattcaaaataaattaaaattaaaataacactagtttggttcatgattaaaatgtaatagctagaaactctatctttactttttccccagataattgatcttttatttccccttctagtctagagagggtgttttttttttgtttttttgtcttttttttttttttgagcggggattcacttttgtatcttcctaagttcttagcatagtgccttctgcatgctgtgtagcagtgtatttttattaatgggccaagaattaatttcatttaatgagaaaacaaaggcaattaaacctatattctgatactaccgttcttcacctgtctctaaagcaaatcctttcagtttggtcagtgaaccttcccattcttatgtttactattataagttacttttgttgtttaaggaaagagtttgtggttccttttgcaacttgaacagcaaattgtattctgtttcttctgtgttggtctgtataatcctctatgaacgtaccgttattattaggtgcatgcccaaaaaagaattgaaaaaataaatggacccataataattactcagtaaaagcaagtgtgtcattttggctaagaaaatacaaatgctttgcttcttaaaatttatataatttacattaaaaattacataatcatcttcaacttctatataaacacccttgatttatgtgccctttacaaaaggagacccatgaatttgcctgagtttaatgaaaagtctgatatagttacagtagttgcagttgccttaattgatcctcttctccagaaatgacatacccagaacgacactgttctgtttctcaagctgtggtcacattaatttttttttttttttttttgagacagagttttgttcttgtcgcggctggagtgcaatgacactatcttggctcactacaacccctgcctccaaggttcaagcgattctcctgcctcagcctcccaagtagctaggattataggtgcccaccaccacgcccagctaatttttgtatttttagtacagacggggtttcaccatgttggccaggctggtctcgaactcctcacctcaggcgatccacccgcctcagcctcccaaagtgttgggattacaggcgtgagccactgcacccggcctaaattattttaaaatgaggtataattatgctttattatttattctatggaatttttagaaactgatttacccagttacattttacttgaaatttatatttaaacataggtaaagcagaagagtatcaataaaaagttcccagtttctttttcaaacagttaattttaaattaaaaatttggaatggcaagtgattgcatcatctataacaagaaagacagaatagaggttctttccacctcttaataatctgtatgtctatgattttacatccattagttagaggcctatatttgtagtattaccttttgaaatcacatagctcttatgcgacattaagtattatttttggcatcttgaagatagcaaaatgagctttgtctattttttaaaccatggtttaaattttttttctttttttatagtggcattaattgctgtggttttatgaacaatttatttctggtttttttttttttttttgaaaaagatatacagaaatggttctctgactcatcaaagttctgatagattcacaacagccagttagtcacaaattgtagcttacagctacaaatccgcctggcattttttgtagactgtgatgtctactgcctttacagtagcatattcatcctttaaatgccaccatgctgaaaatgcatatttaattttatgaatgcctttaccagagcttaggtaatttttcaaatggtaaaatgtaatgataattagtttctcatattaatagcaccataaggtctttttctaatttcaagaaaactcaaaaatgcaaattgtgtacattttgtatgtgtgataaagttttggtgtttttttcttttaataaagatttattttcttttagagatacatgctgaactacttagaagcaaagttatatgatatctgggatttgcttcaaagtaccacagggagagaaagtgtagatggggataaagatgaaataagatttgttatgagttgatcattgccgaagttgggttatcggtacgtgaggattcattacaattctgtctacttgtgaatacagttaacatttttcataataaaatacaaattttatagctcatcatttttataacattttactatgagttgataaacttccattaaagtcaacagcactcaagatgttaaaaccaaggcatatctctcaactccctgcttattccaacaaactgcatggtatagtctcttagtcaactaagatgatgacagtctacattgcttaataatttaattgggtgaaccctgttaaaatatttattgcattagttctatcatgattcttatttcaagctctcatgatctatcttttggcagtattaaatatttatgaaatgaatgagtgaatgaagcccgaaatctctgaattcttttcctatcacagcacctttgcaattccttcttacttgtccacatcgcctcactagattttaagctttaaaggagccgaaagtgagtccagttcaccagtgtgtcccaggctagtgcagcatgtggcatacattcggtcttgaacaagtatttatggaatgaatgtattgatgaatctgtcttctgaagtggtcttcatgatttctgtctctgttttggccagtccgccctccatttagtttctgggggaattgttttaaactgtcattgtgatcatgttttgcccatctatggcgtttctcctatgagggtaagcattcagacgtttgtacaggaagctggagacccgtcatcctgtgggacctgcaagaggcttgctcctcttcttcatctttcaccactccacacactgtttacttgtgtattctgtgccatctttttttctgagtatttcctctctgagaatgtcatcctcattcacattttgaaaatggcaccaatgagaaatgccttcctcatcctggggagactgagacgatatctgtcctgtacatcgcagctggcgatgtagcagcaaatgccaaaacttccctgctctcaacacacattgtacctctcaaccattcacaaccattttcttctaatcattttcctcctcaccaacagtgagcatccctagagcaggaattacttttaatttctttgacatcttcattttacctggccagtacagaaacccagtaaacgtttgcagaaggagtaaattaaggaatgtactttttgctaatcaagtgaatgagttttccataaaagctgtgaaatcagtgatatcgtgaccaacatacctgaaggttgtttttcccatttgcagcagttatcctctgtcgaaagacaatcttctgaatcatataaatctcagaatgaaatactgaggtaaagaaggcctttgtgtgaaccaaggggctaaaggaaacaagactttgggtttttagaagtttaagatttatttagtaatgggaataattctgatgataattttaatgaaggcttctgctagcttccatggagattgaacaaatatttcagagctccaagacagctggatcgttgacactcagaatatattttgtaaaagagccaaagtataagaatactaaaatgttgcaagatgagatctgtcatttgttgacatgaaccttagagcttaagaaagtcatggagctttgggtttttctctgtttctcgcagatatgtcttctccgactactatgaagaagcctgaaaagccattgttcagctctgcatctccacaggattcttccccaagactgagcactttcccccagcaccaccatcccggaatacctggagttgcacacagtggtgaggagtttcaagcatagaggagaagcctccttcttgtctgtagggcctaacccccttagggacggagcaaaagtttataaatagagctatggcaaccatattttctcaacccatatggtgaggggcacaatccgatcaagtattttttcttctcaatttatgagaaaagatttctctgggtgcaggggctcacgcctgtaatcccagcactttgggaggctgaggcgggtggatcacgaggtcaggtgttcaagactagcctgaccaacatggtggaaccccgtctctactaaaaatacaaaaattagcctggcatggtggcatgagcctgtaatcccagctactcaggaggctgaggcaggagaatcgcttgagcctgggaggcaaaggttgcagtaagccgagatcgtgccactgcactccagcctaggcgacagagtgagactccatctcaaaaagaaaaaagaaagattttcaaagtcatacaagtaaataatatttataatatgtgttttaaaattaccttaatcaaaaagattgttatcagaagaatgtggaaaatatgggtacatagctatcttcattatagcttcaggattggtcctgatattttactaagggaaagatggaatttcagttatgttgctgagtttagagtgtttctaaaggcattaagacgtaaggcactatttctgtagatgttattttctacatataaatcaatatttatctatatgagagtaatcagagaataaaaggtactttttttgacacttgttttatatgcccaaatcctttgggctagtacacttgatattgtgtctgatgtcttaatttaagtaggaaaatgaatccaatatttgacatttgtactttaaccaacagctaataccaaatctttcaaaaattaaaaatgagatacagctaataattaacactgtgtactttttacctagagaggagtagactgcattttaggtggaaaaagttttatatataaatatgttaatagtgaaactgttattggtttaaatttatagttaggcacttcctcatccttctgactaatcgaatctggtttttaaatctttatgcaaacaatgtaacatcttttaaaataaagtccttattagctttggtttgtaagtatatgttgatatttgttggtgctatacttaaaaaaatgcatggcctttattgctatcattaaaaaattacgaaattgagagaggactatacaacttaaatgtggtataagaacttttgcatttattacctataccattgagataggtgaaaaaatcagtaactgtttcataggtttgtaatgttgaatatttggacagaattaactgagaagtcaaatcacccatttgttacgacacctgatgaaaatattcttatttctaacgtgaaaaaaagtagacagtatatttttatataacgaaacaggagagacctagatgagccctccaccttggtccttcacccgatatttgttctgtatctgtatattagggtctgtgttaggcatcttgttcagaaagatcgtttctgtccttaaagagttcaggatatagtggggagagagtggggccacgtcattggctgggcatctaatctgaacatgactagataacctgaagaaggtttagatacctggaagatatgtgttctgagctaaagtgtgatggcaaagttcaccacaagaaggaacaacaaactaggaagaagaggggcaacctgggaggcagagggacatactaggaggaagaggggcaatgtgggaggcagaggggcaaactaggaggaagaggggcaacatggaaggcagaggggcaaactgggaggcagaggggcaaactaagaggaagaggggcaaactgggaggcagagaggcaaactaggaagaaaaggggcaaactggcaggcaaaggaggcagaggcaacagcatgtatcagtgcattagaggccattgcagcaggcaactgccatatagccaaggatccacaaatatcttcgtctggccagagatgaagccaaagaagtgatccaggactcggtctcagagtacctgaggttgtgtgtactgaaaaacctgttgggattttattctggaagcagtaggaagccactgaaataattttagcggagaagttacatgattataatggtgtttttaaaaagtaattcacatagcactataaaggatgttttggaaggagcaagactgaaggaaagaagacaataaggctttgcaataatgtatgcaagaaatacacatacatgtgtatgtattctttcataataaaggaaaactttttgtcttgtattttacttttcttatttttttttctttttcttttctttttttttttgagacagggtcttactccaggctggagtgtagtggcgtgatcttggctcgctgcaacctctgcctcccaggttcaagcaattctcctgcctcagcctcccgagtaactgggattacaggcactcaccaccccgctcagctaatttttgtattttttttagtagagatggggtttcaccatgttggccaggctgatctcgaacatctgacctcaagtgatccactccacccaccctgacctcccacagtgctgggattacagccgtgagccaccatgcctggcctgcttttcttatttttaaaggactagaatggcttttatggaaaaggtagtcatttttactctcagtttgaaatacgacattttacccagtggtatcaggccacctacagctcatgcaagcacagtgccaggttgcccatagatgtgagttcgggtttgatttctgcaatttcacttgaaaatagatctcctccagaactattaaggccaaattaatctcaaaagctaaaggacccaagatggaactatgtatatatctttccagggtttgtgtacagatgtgagcaaaaatcatggttaaaatgagctgagattaagagcatttagacactaagtaaaagatgcccagtttttcttagatgtttgtatttccttaaatgatactttcaaatgggtatacttcttaaataaagtaatacttcagtaaagagttttgttttaagaaatacgcatttgttctctgaaatgcatacatttgatggaggatgctcaaacttcagtatgtaggaagattacatggacacttatttaaaatatacattttggtgccttacccctagaggtcctgatcccctaggtctgtgtgtagaccaagggatctgcattgtaagaacaatacagagaatttcagaaacagtgctctggacgttcagagaacaaagtcgtgactataaaattgaatttatgttttttctattctatacattcttaatttcttatatcttctgaaaaagttttttttgggagaggtaagcaatacatcccataaataggtcccacccccccacccacatagtttcaaagttggaaataaatcattctaggtgatttccctttgtaggttatggctaaaatttattttttttcatattctttaagttgtctcataaaacattagacatttatcgtttataatttcctattatttgaattgggaaatattaaaatagaaagacatttacttttcacttctacatatatttgttggtagttttaatttgtatttctatgattatttctctcaacattttagagataatgatcatacgattacactctttctccatctttcaaacttaagatttatatttcaaaaactgaacaataaattataagaatactaatgttgagaagttatagtaaaattgaacattgtccacattgcatgtgttttatatagtatttccctttataaaattattataaaatatgtgatatatgggtaaagtaatatacttacctatatgaaagcttaaattttcattgctgtgtgttttattcttggttttatattaacaatatcttttaaactacatatagtaaaagttaaagtagaaagaaaaatagttgcagaatagagctcttttggttttgaaagaaacattttcattaggagagtttctagctctatgttccaatgttcataagcatttataccatgaccagacaattataaatgacatgagatgatgttgtattagttattgtctttccttctaaacaattgccaggtaggatgtacagggaaacgttttatttgaaattgaatttcacttttgtttttaattttggtagaaaatttttggctcttttgccctctacttaatgctgtgacttgctctggacttatgagacaaagtgttttttgtttgtttgtttgtttgagatggggcttatgagacaaaatgttttttgtttgtttgtttgtttgagatggggttctgtcaccaggttggagcgcaatggcgccatctcggctcactgcaacctccgtctactggattcaagtgattctcctgccttaagctcccaagtagctgggattacaggtgcccatcaccatgctcagctaattttttgtattttcagtagcgatggggtttcaccatgttagccaggctggtctcgaactcctgacctcaggtgatccacctgccccagccgcccaaagtgctgggattacaggtgtgagctactgcacccggcctaaagattttataatcaaagaatatgttttcaacgggatatatctttgctcaaagaagtgttttatcaagtattgacataacctataaaagagaaactgattttgtaaccactcacagagccaggaagcaagattgttaattttctagagtgatgttttatctctgtgtagttagccgtactggtgttgagaataaaaatgaaaaagtaactgttgatttaggagagcttggttaaatcatggggacaaaaatgaatggttaccagttttgtagtttcacagcattcttcaggatcagaatggagcaataaggtaaccagctgacgagtcaatctttccttttctgtcttctgcagtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccaggtaaaaataagagagaaaataagattagcacctaagggagatgggacagatctaattctgagacacaaaggttagtcagacagtgtgtctggcagaacgtcaagccttgaaatccatcttcaggaagttgcttggtgactcaataagtttttatttaaaggtggctgaatgacaggtaggaagtgtgttgccccaaagggtacatttgtgaagatggtttaatgtttttggattttcactgactgaagggaaagtttatgcagaaagtacattgacaggaaagctctgggctggagttcacacctcttaaatacctggtttgacacagagacaatgtgcttatttcaggcaggagtaaggtatgtgctaaaataaacacacacaaaagaacttacagttgtatttatagaccaactattaggtattaaaataagctttggtaatgtaaacattctcagtgtttgatgactacttgaatattctttgcagagacatgacttacatttaataatgagtgacattactagaagcgtctttcttttttttggaaacattgtgcagtggttttggggattcattttgtaagtgtagtgactcatgagcatttctcactcccctagacatatggtttcttctaccaagaggttacttcataggaatttggtatatgagcattttccacaatcaagtagacagtctttgtgccagacctggggctatcaataattgtaatatctaaaacatgtaatgtaattttgatattaggatctgatatttagctttgctgctttacctctaagactcctgtccacttattataccttttaatattttggagaattttcacaaacattccgtcattactacggtggaacattcctgaaatgctagtaaatagtgtgtgtctatcaatttaaattagcaaagaaaggtgagaaaaaaatccctttggtcttaatttgttaaaatgaaacaaaatggtcctttctgaacttttaatttagaataacaacgcatccaggaccctttgggttacttaaaaagttatcattacttttagtttgactgactgagatattaaactcaatattgaattttgaatttgaagttaaaattattatttgtattttagaagaaaatgttaaaatgttgtagcacttttcatgactgaagtactaaagacagctaagtgagagtgggatcttagtatatcgtttagaaataaaatttgttgtcagctcatggattcagaagtctcagttccatagagcattttgctagactcagctgggaacagtgcacacaaggtctgattttaatttgtgtagaatttccatgaataacaaagtctaattaagacatccattaaaagtccttaacgttaattcagtgtggaaaatcttagagttccattggattttttttttaactgatgtcttaattaggcactgttaggggaaaaattatgcaaattaaaatcaggcccttagtgttacacatttctttaattattcagtgcttgttttacgtatatttcaatttctttataagttaagagggcatattaggtgataatctgcctatattgttctcagtttttcttcactttttcaagatacatatcaccttctaaggaagcatattactctcatctcaaaaaaaaaaaaaaaagaaaaagaaaaactagcaacaaaaaaactctcaggattttgtataataggaaccgtgtataaagtagaataatcctttcctaatgctgttagcttcaccttcagacaagacatctctcttttctatctacagtatgaaagttcatctattaacagccttaaaagatagaaatttttagtgtagcttcatctgtttgaaccagtagaaaactgaggagaaaatagccctcaattcttctcaccctgagttttaggaaagttgtctgcattggcttgggaattctttctttgtcacctttattcttttcaaatgagagaagtgtctactagttcatgttgttcaattccagtaggtgaagtttgtagaatggtcagggtaggataatatatttggtggcagcatttccttgaaattattgtcattctgctccagacattttgttccaggtaggtactttcagactgttttggtgaacactgtatgtagaaacatttttaccattgaatgtaccaccaatgataaaatgagacctgtcttctttcttaagatatttaaagcacttatttccagtgttcagataaccagaaatggatggcctgctgtagaaacaaactactttttccctttgaaaggaaaaatgggtctttatagttaactgcagattttttttttaaggaacagtgtatctgctttgatttttaactccaactcaaaaccaattaatttgcatttcaaattagaattcttggtatttaccattttagctttagaaatggaaaaacatcagtattccttcaccattcacttctagtcagctgttgcttcccaatattctccagcactgcactgattttgatttttaagataagcaactgagatgccttttcctccccacagcaattttgagattaattgcattactgctgcaccaattatagtgagacagtcatgctattcaatggaatattttgaataaaattagtttaaagatgtaactctcccataggtttccatattggaaaactctggtcaattttcctgacatcaagttaaatacttaaaattacccatgatgaataatcaggatattcaggaagtccattttctttatagaataaataatgtggcctctgaggagcctaaccgaagacttagttcatgtctctaagtcacaatatttaagtgttattagctgttcatctttttctctaaataaatgtctacttgtaatttatgtgcagatatttagaaaaatattctgcttcattttttttttgcctttaacagttcagattataaagactatatacttgccgagaatagcctcccagcaaattgcgatgaacaccgtgcagtggagaattccaacatgggtataatcaaaaataacattctcagtctagaaaaatatattccactatttcttcaaagagtgtatccttaggattttgtttcctaccacggaaactatttttgtacccaggagctaaaactcagatagtaacatcttttctatcattgcccaggggattttctcagttaattcccacaaatgtcaacaagaaatgttttgtgtaactctccatgcaccaccatggatgtaagagtaactcaaataacaatgctcatttgcttgtcctctgcttcccctcagtacagtttaatttactttggaaatcttttatttgtaggtgtaaggacaaacgtagctcagcattttatatcattgtatgacctctgaaattttagatgctttacatcttattctatcttcttgtattagtaaatcatcaaaagttgaccatagatctcggaatctaaattgcctaatgtgtgcatctcagcacacctgtgtgtaagagagctagagttttgtatgcaggagaatggttcttgactgtaaatgatgaaaattccagaattcgttgtatttgatctcctagatatttttgtgtcctttgtttcagtgatatcatcatgtaggtgaaaattgtgttctaaaagccaaaactgactcattatagaaaatgaagagcagagaataaggaagcattgggttccaactgtagctagttcagtaaggaattccattttagcctttgggctaagcatttaagtctgcacttgagtttcttggcctactacatgaaaggatcaagtctacctggctctcaggggtgctgtaaagaggaattcacctataccatgacgtgctttgaagatgaaaaccttctttgaaatgctgctgctccttattactaccaaccattgactggcctctccgactccgactcgagagggcctgtgtggcgcctatgcgcagtgtgctggatccacacagtcgtgtgtgctgagtggacttgttgaacaagatgactgccttttggattgcttcacccggcattctgtttttgttttgtagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccagtaagtatttccataggaaatgagaaatgtccatcagaggcaccattggatatctgatccaaggtggaaaacacggcaatttttccagctacctgaccagatggagatttctcatttaagtggagctagcaggcatggatgtggccctgctatcacaggctctctcttctcaaattccagtcagtgaatcatatttgaaaagggagaagctcacttgtttaagttaacagctataacaaaaataataagtcatgcctgcttgttcaaggtatacattgaaattgcactgagtaacataacgcagaatacaaagttttcgtatcacccaaagagagattaggtaattggtacttattggagcattcctatagaaatcaagccccttcacaaagcagatggaatcagtgcctctgtaaggtaattgcatgtttacatcattgtaggttatgtcattgttaaaaacagtcgcataaggttgggaacagatgaggacatttcaaaacttagtattaggcacatgtaagctacctgtactttcactatctgcaagctttttttttaaaaccttttgattattttgcttatcattggtacatcaaatactgtgctttttagtgtggccataacatttaaatgtcagagatttagccagtgaaccttcctaacacgtaccaataagccgcatcattcctttgttttttcatgtaaaatacttagaagtatagaagaaattaattttgaggtggtttcacccaactgtcagcttcttagtactggagctggaatgtacaaattggtgaagtagaatggataaagctatcgaattggtggaattagcatgcacctcaccaattatacagatatcttcaattcaaaccttttttttttctttcttagagcaagaaaatccccatgatcttgaaatttccatgtgaatcagagacaatcagaggcatgcaccactcattctttctcagccattggaaagatgctcttttttttttatggtttctgaaagactaggaaggaaccctataagaaaaatggacaatactttgtacagtgaattcagcatttctttctcaaaattcatgagccccgtcaattaataagttcctataggcttgtaatacccatcagtaattcttaatgcttagaatacttccctgaatgcacagatggatgcgacctactcaggaaaaactaaaaattattttgttctagaggtttgctatgtgcattacagtcaccaaaacactaagtactcattttaaaagtggatgtcttcacatctttgagcaaacaatgtcagcaatttaaataaaagcacacagaaaacaaagatttttttttaagtagttgaaagattatcacaggataaatggtcaaaaccaagttctagaaactctgatgcctactcttgtggtgttattaatagaagagattcaggagaggatcagacccaaatgatcacagttcacttataggagtaccctcagcctgtttgttaatgaattgtttttatacttacatacaggttgttcaaaaagggatctgatttgactagtaaaattacaaaatattcaaaaggagtatcttggttgtataaagatggctgcatcagtccattttccactcctacataaaagaaacatagtgagtagtttttctttcctataaacaagcttgtagctccagcttcttaggcaccaccagtaataaaaaactggtcattgaattgatatagtactatggtcaaagaaaacacagaagccaaggaaggctctttctcatagttgaaaagaaaaagcagcatagatttggtgctcttctgtaagggtgaggctcatctccggctgtctgtgaggtgtggtgaattccagaggcttggagattgagtaggggtcactggttgctgatggctgccttgcatgtccccttattcaggagcaattaaaatatgaattgtgagcatcttcactgtttttaaaaagttgacctaaaaaagcttccatggatcaaattctgcagtcctttaagtgaacaaggcagaattaatatattggttttagaaagccagttcatttaaaatgaagcctggattcctcattaatctggtggttttaaaccaaacagtgtagctttcttcagaacaataaaggtaatatatggtaatatggagcagtgggattgcctagttctgggaagatacctcagtcctttccttgtgaaaagtaacaaaagtctttaggagtagctccctattcattttttttgtgtgtgtgtgaaaaatttactctataccaaaaagcaaaaagcagttgtacaaaaagtacttgcaaatgagactataacaatgtaaggaatagtcaccatatatacttactacctagtggccaactatttaaaggtgcatcagctttcttcctggatcagttacaagtaattgatttttgtatgtgtgcttatgggaagtactttttttcaaaaacattcctatcagacttgaggccattttcacaggtaaaataccgagctgattcattctacatgatacaggcttctccttcatgatagtaagatttgatttcctttttagcaaaacttttaagaaagacattttccatcccatatcattaagaacatctgcttaaattccatcattaaaagctgtcactttttcctggcggactttcagtctgctttacatttagaatcatataccatcattgattattttatattagacaactactatctggtgaaaaagtacgtctaggaacagggcccttctatttatccaatccttagtacctccacaggacagttactagagcatgtaagtgtgagacacccacactgaagtatgagatctgctttactggatagattttttagggggaataaactagttgatttgaagtcaattattatttcttttctatcacttggtgttcactcagacaaaagagaagagaaatgaagacactttttttttttggttgcaaatcccacttctctgggtttcttatacatggacagggtgttcgttctgatagttcacaatttttatctttgtttttgttcttccttaatcagcctacacagcctcaggcacatctcaagccaatcgatatgtgggactaagcccaagagacccatccttcctacatcagcaacaggtgggcaagtttcacccaggtgtgacggtgtagccacgctttcgcttccgtgcttctccatgttgcctctcagatccggactcagaagggggctcccggggcttctgagaccaaaactgatcatttcatttcccagaattttttctcattgatcctttgtttctcacctctttgagtagagtttctcaaattggctcatgaccttttccatctctgtagcatatattgataacatccatgagtaatagtgtttcagccaaagtgtatttttctcagtctcattggctattgagaacttacagactatagctttcaaagacaaaaactgcaaactgttttaaagccaactagaatagaagcagtatataattcgagtttttgagtgatttcttattttccagatgttttgctcctcacatttgtattttagtccaagacgatgagttacgaagttaaaatctcaggcgacacttcattcctattattttaatagctttaaattggtttactgatttcagatgtgataaaacacttttttttggttctgctttcttacatcatttatgtttctagtagcattttaaatttcacatctcattaatgctgtaaatttaatgcaaatgaagtgtttacccaaactgtgaaaacatacagccaggattaatggtggcttataaacagatcagccacagtcaaaagcatggaccataccaatgtagaaatcccacgattctagttacaggataagagacgtaattctaaacagttccgaatttaaatatattttatgatgcatatgtttgctgctctcaagttttgatagcagagcagtttgaaattaacagtatgcaaaatattacataggggaaaattaggctataataaataataaagagctggtgttaactaactcgctctttatttataagttgcctgtgcatatatatgactttttgtgtaggtagtaagatacttttgcccacttacttcattcttgatctgttcacctcacatacccttgttgtgacctacctcaactgtgcttggtgtggagttctcaagtcctttccagttgcagcccaagggggcagactgcatattagaggtcaccacatgcagagctcagagaaaatcataaagatgatagcttattcagaatacttgatgttttgccaggtttaaaaaaagcaaaacaaaacaaaccaaaagagtgagaactaactgaaaacatctgtacacagttatgaaaataccaaataataataattagtggttttgccagccattggcttctcaacataattctctggaatgttgcttttttttcacctctaaaattgttataacacgaaatgagttataattactagaatatggttctatttgacagatgtatgtgtccattgtgttttttaaaaaacatatgcaggatgtataagtttagaaacttgttcttttaaaaatcattacacatattctcaggaatatttttctcatgggatttgcattattctttatgacacatctctaatttccagttaatttttaatgcataaaacatgcctccattatttaaacctttagccccaaatgctagttagaatactctgaccaattccatgtatttggaggcagccttcctcctccactaccctaacctatggcagctttaattttcttatcccttatgataaatgtcgaagcctcatgtaattatgattactaaagtccattaacataagaattacttctttcacatatctaaaaatatatcaagaaaacttagcaagcatcatgaaaatatgaattttaatgtagatagcattctggcacatgatatattttaaaaactatgagttctagaactataaactattttaaaatcaaagaagacagccacttatttaagtggacaacattgaatcgagaccacttacaatgtgaatacgttttgttcagtcaactatagttaatacttatgggatacatgatatatattaatctttggaagcaaaaaaaagttctttatagctgaaaatgttaaataccatgcagacagataatttgtcctctatgtaatgaaagagttagtgctgctttttaatttgaagaagcccatatatgctttattttataatgaactccagttttgaggcatgcagaaaatacctgtaaataaatgcatatcatgctatagatgtatattagtaaactaaggctagagtcaaaagcctattcattttagcctttcaaattttaaaagaattatagaaatgaagttttatgtttactatccaggaataaagaaacagaaatagtttaaatgacttcagtaaagattattctttccttcagtagaaatgagattgatttactgtgtcctttcattactttacaaagatttaaaagagaccattcttctagaggcagtttctaaatgcatttggtttaaagcactcaatgatgaatgaaaaggaaaatcaaggggtacatgaaataaaggtaatcaatcatgttatattagctaggagaaattcaaaattagaaaggcagtgctttagtctgagagggttcttttaaacattccctatagcctttaatatacatgatcctttaagaataaatatcgtcaccaggtacattcttcagttcatggtggctgctttataaagatttatccttttaggttatgaaaagtactgatgtgtagttttgagtgttgtttttcttagaaaagaactttaatagagcctacataaattagagttaatgataaatttaaagtggtcatgtaattttgactattttataaataatctttccacaagatgatactacagtggagtttccaatctggtcattttctaatacataagcttactagcattatcaaattaagatgaaaagctttctaatgttaaaatgaaccctgtacttcacctgtaagagtaatacattcatagtgtcaaatctgaatactaaaagtatacactttcatatcatttacttggtacacagacaattgttattagtaattatacatctttgtgttcctttttataataattattgctgatggcattggttgctaactgcttgggaatactagtttattctgactggaagaaagttcacctatcactgaaaatatatctcatttgaatctaaaaaataaattcacatagtcctggagactatttcaaaaaggttcatgtaaaccagttgataatctgccattaaaaataatcctctctaatcagtcacaatagtcagcacataccagctgatcagtatttgactttagactttttctttatctcttaacacaatcttgaatacttttcaagtctagaactagtctgtctttgggattattggtttagttattgcattcgctattggcatgggggaaatcttaaaatcagaacttcagttggagcttcattcttctttaacttttctattggaagatggttttggtggcttgaagaactcatgggtcctgctttggcaaactgaactgattagtctctgctgagaagtgtctttttatggtttggaacattttcagaaatgtggaacacccccccgccccgacttaacttcatagaagttcagtaaaatgcagtatatccttttctctctcatactttataattcacgaacacattgtgcaaattcgttatgataggcaatgaaggaaccacgtttcccaaattttatctccctgagaaaatgggaactatcaatcagagtgttggatgttgcttaggaaatatagaaattattttataattcagtctaacaattttagcatggatgaataataagagacaacttacttgaattagcaccagtttcttatctggtctacctcatagtgagttgctaatttcaggcctctttcctttgctatcatagaaagtttggtagtattaatacaagagaatctggctaatttgattatcaccattacatttgagtctaaggtcataataagagcctaaattcttactattgtacatcaacatatatttaaaaatctcattgtaagttggaaataaaaagtttgcagctaagaagcttcttgtttagaaataaaagttcaccattcaaacaagccattgaagtacatattaacctttgatgtatatttgagatttcaactgaataaattaggagctcacttttgccttccctaagtgagacaataaagtcaagtaaagtctagtttataagaaatcggtcttattttcataatctcaaaattataatctcctgactatatatatattacctataataagagctaatgaatcagtggcctgatcaattcaggtctttgcattacttctcacagttgcatggattttattggtgcttgggcttcagcatgttacatctcttgcatgactatataatgctattatttgaatttcaattactggtctagtgtatatttaaattgtttcaacacttttcttataacacttttgtttttaaaactagaatttgaaagtacttctcattacactgaaaatttctgttacacaaaatggcctttttaagaaattacttctgtaggatttttttaaactaagatattagtttaaatcttcttataatatttgtcctggcaaatggcaaagccaaagcttggtactaccattggaaaggtagtcatttattagaggcaagcaattaaaaggacacaagtggactatgaacaaacttttcaatacagtcaggaagcaggctatcaacacttgggctgttcttattgtgtctgttatcataattgacagcttgacgtaaaacgctatcacatgacttctgggtaggtatgtaagtggataagaggtcacttttcatgtatgctggcttgaaaggaaacacatttaaaggaagtttcagtcgaaataatggctatgcaaatgtttagctctttggctagttcttaaattcaaaaaatccttccattgtctgtcttttgtcattccctggtttgttcacttacctttactgggaatcaaagactaatatccagataagctgttctaattaatgtaaaagtaaaattacattttatgtaacgttaactttaatcaacagaaacacaaggaaaaaattatcttcttttctgaaaatattaacttagatctcagttgaatcagggaggtagagggaattctgaaggttttatttacagatattttagcattaaatattcttgaactgcacataagggacagggtaggaaaggaacaatgacaggcaactggtgtagtgggtgagaaccagggattaggagtcagaaggtttgggttttagtgttgatgtgacagggcatttctaaccttggacaagtccttaaaccttggaaaggaaaatgaagaggttgaactacataagctccaaagtcccttgaaaccttaaaatttacaagttgtagtagcctctaatttaaaaacaaaatctttcattttctaatacttatcttatgatttatggttaataatgtttattctgctcatggactatgcatactcatttaagttaattctacttctgctaattaaattaaatatcaagaaacatgggtttcagaaattggcactagaagtgacttttaagatatgaggatgatcttgagtatcttttttttttgtttgtttgtttttttttgcatgtgttgtatgtgaaacatacaacacaattttattctgaccatttttcttgttcataccattccttcagaggttacatgctattcatccagagaccatttaatttgctccatgtaggtaattaatattagcaataaaataaaattctcctaatccaaagtatgaatattggagtgttaatccttttaagcatctgttttccaccgcaaaaagaaccttcaccccttaaaaatctgtttcattgagggtctggagaaatgaagaaacacaagaaaacataaaacatacctttcaagatgttctcctgagggccattgtaaacgtaaaaagaaaaaaaagtgagaaggtaaatttgcctgtgttgattgttctgttcacagtttaatggtttattggttcagttgagatttgttgtcatcgtaggaactgttagtacctcagcctgtttgctgagtctagcaaaatagaacattttgcttaccttctttcttttgttcccaaagctaattgctgtgtatttaacaaaagaccctgttaataacaaaggaggacccccatttgaataaacaaactattagtctgaagtcacaagcaatattaattctttatggctatctgctacttacatgattatttgagtgtagtttaggaaaggataatgatccaaatcttaggtgtttcccctttatgtagccatttgagaggaaccagatggcccctatcctttttctttttttctttgaagcaatctgatttgaactgggccaggaacaaggttctctttccagagaccacagaactccaccctaagaacatatgcagtgaaaacttcaccttcacatctttcttatttgtttaaactgttccaaccttccccctttactgatagcttttttggaagataatcttactttcttagttcaccttttatttggttttgaaattctgggcattttctagacaatagaatttcatattggtatgtgcatataaattaaaggattaaaatgatttatatgagtgtgcatttttgtaaggatatgcatatgatcagttctttttgagagtctatattgttacaaaaataagaattgttccccacctccacatgaaaacagacaattctaacagactgaatttctaaactgagtggcacttggtattttaaatttgattactattgggagaaaaaagcaatttcctatttcttaataaaaaatacttggaaaaattcttacagcattcttaaagctttgaacttagaaaaattctatataaatgaaaggcatgtatttatgtgccacttaaaattaaagttttaaaataaaaaaagagaatttacagctgaattacctaacactgattctgtcacaggacagaaactaaggaatcaccaccccaaactcaaaaaagattatcacctattatgttaaacttatttaaagcctaatgtaaaattattttttattaggaaaactgaattatgctaaaggcaagaatatgtaacatgaccccaaaagaagcttaaatacatgtagtattaaccttttaatatatagagtctgttcacaatttgcttggtcaggaatatcttggtcaaataagattagaaattgattttcttaggaattactatcatggaaatctttggtgaataagtgatttctattttaatgatttaattgcatcccccacccataccatcactttaaaatttcactttatcagggagttttgttagttccaagatgctttatgaccaagaaggtttattaattgaaaaaaaccaacatgaagagagaggctcttgctcaagtaacctggcttaagttatagcgtgtctcctcagaaagttcaagaaatgttgtaatggtagtgcacaatctaaacagataaattagtttcttatattttacatttttagtaactaaaaggaaattcaatgctaattaatatattgccaatttatttggcattaaattattgctaaatatatttgttgtttattttgaatgtacttaagcatatttttctgtttgggagaaaatatttctattgcatatatcttaaatagatgataatgaatagctgtagtcaggtttatccactttgggactacttttagaaaagaaaagtccaaaaatacgttcatttttatgtgtgcagcatatggtcaaagatagcccatttgacatttttgggggtcgtaaaacaaacaaacagacaaaatattagcaacattaacaacaaaaaaactaactcatttacaacacatccttctgaggagatgtggtcctacagttgtctgtgggacaataagcaatcagtgagtggtatttagattcccctggctttgtgaaagcatattatttttctgaaaacttctccaacctaagctgagagccccatagatactaatctgaagttaataattaacataattaatatgtactatgcctaaatatacatctcccctcttccaaatgtttgattcaaaactagcattttcaccagcctgggcaacatagcaagatcttatcgctacaatttttttttttttttaattagccaggcatggtggcacgaacctgtaattccagctactcaggagagtgaggtgggaggatcacttgatttctggaggttgaggctgcagtgaaccatgatcgtaccagtgaactccagcatgggccacagagggaaagcctgtctcaaaaaacaaacaaataaaaattaaacaaaacccttccattttcattgactagagtagaatcagtaagtgataaatcattaacattcttgttatacaaagccaagtttcttgaactgttttttgattgttttcattgtacttttaaaacttttacagtaaaaaaaactgtaaaaaaaaaacagaagacaatttgccccatcacactaaatttgattagacgacccattttgagaacttttaagaaatcttgccatattgcttcccgctagactgaacacatttacttctttgaaatattgaaagtatgtcatctgatttaaaacaaagcaaagtgtacttttttttccttcatgtgagtattttggtccattttaagagtatttatgaccaggcacccgtggctcacacctgtaatcccagcactttaggaggctgaggtgggcggatcactcaaggtcaggagttcgagaccagcctggccaacatggcaaaaccccatctctactaacaaaaattaactaggcatggtggcacactcctgtaatcccagctacttgggaagctgaggcaggagaattgcttgaacttgggaggtgaaggttgcagtgaactgagatggtgccactacattccagcctgggtgatgaagtgagactgtctcaaaaaaaaaaaaagaatatttatttttctttctaatttatttactgatttatgacttctttatgacatatatcctgagcagaatctacatgtctatcaatctgttgatctatctatgtatatgcagggaatttttttcagttctttaaatcataaaatcacttttacttgaaatcctgaaatatgcaaataactaaaacacgtggtttggaaattttagctagtatttttagagcctcatagatcgatagaaaaatgagcaaaaactatctttctaaaactcctgaatcactattacttagtgtgtgcagaagctcgagagtctaaaagggaaagtaaagattcttaatagcctatttctttggccacaacattatcagaaatgtttaaaatagtttatcataaattttaagtttatgataatttatggtactttggttccagtcatcatctggaaattctcactgaaaagcagcaaacaaggtttagtggattactgtgaagaagtcatcttttcaatgtaagatgctgttaatttacagtgtggccatctgaaggttaaaaacgatgattttctactgtgtttccccccccccaacccagataagtttactttcttaagaataaaaataagcaatatatcttttcaataaatctgctagcactgtagggcagctgttaaccaagcagagctggatagggttactcgaacaatctctgaagggcagagctgatgattcggagatctgggaagaatttgtttcagcttgtattcagtgcattcctcactttcttcagatgtagtaaagtattttaaatgccattactctgagtttaaaataaaactagaaatgcttatcaactctttctaaacaatgccagtttaagcaaaacaaaattagtaaaaggttaaaactgaagaccttgatgcttctaaacacaagttagggcgaatgtttgtaaggtgggccttttctcctctaaactgcatgtcttctatgttttgcaaactgcatgcttaaagttattgattattttattcagtgcagattatttggtgtgatgcatagaaaaaaagcatttttattttctttctaaaatatatctctctattgaacattaacgtttgctttcattccagctcaatttgtactctaataatggctaattgttatgttctaagcacttgtttctcttgtatgctttaattaatagagaagcatattgcaatagctttttctaaaaaagagtctaggaattttgcttttcaagaataagatttttttttgctttttttttttctttaagttgcctcttgggaaagtaaggttaatgccatgtacagtactagtttgcatgtgttcatttaaatactaaaaactgtagtactgctcgatccatatctgactgctaggtttcaattgacagctgaggatttgtgactggaccatgaatcaaaacggcaggcatttataccccagtaccagtgaggatacattgggaattacttggcaaaggtaacattttaattatttccaaccctacacttacacctaaaaattacatgagctatagtgtttgtttttaactagctttacagaaaatatatgttaaaaatttagttgttttggctatgccattcttctttccctgtcctcctcctttatttcttatgtaaatggaacgtcaaattaagttgggactatagtatatgcttactgatcattggaatttttaaatgctataaaatgttttctacaatttatactgtttttggtgggggagggggtggaatgtgacatttagattttaggacctgaaaagtgaaatcacagctttagtgaagatttttcagctacctgaggataaagcattggttttcacattgtaggtttttcttattttaactctttcctctactgctaattctaagccatttcactgttcatttttttcccctgttgtagggaaaaaaaatagcaaaaaattttggttagtcaatttaactgttattgacagcacccataaattttggagtaggaagattgttggaatcagtaactaaagaaggaatttgttaaagttttaatttctgtttgtatactgatgtgattcatggaagattgaccttatttggttggctgagaaaactattctaaaacttcattttcaaaaccagttctgatactgtttcatgcattgcctttagaaagtaagtatttcaaagtcagctgcgcttatgtattatttattttatttaagaacaaattgtgtcaaattgacaaattaaataattagattcatggtataatcataagtaataagaaataaaaattggcagaagagagtgaggtaatcccagaaggagttcaccagatagagttgacataattttccaaccctgctctgatgttaatcctccgtttacggaaagtgtctatagaaaggtacatactcagatagagttgtagatcgtctgcctatctccatattggttcacagaaactgctgaagagtagattttaaagaatcaaaataattaaatgtccactttaattcagataaaaattaaggaaataattcagattatgtttttaaaaacaatgactttttattaattcactaccatgtgacttttcttcttgaagattgatataacctccacttttaaaaggtatacatttttacatattgtgatttttttaacaagattgtattcatcctcccttttgaaaataatacaatatatgcttataaaaagaagataaactcaacgtaaccatcttatccaaatagccttaatgattaatagtcttaattaagtgaaagtatctcattaaaatattctgaattaatatacattttaaagtttatttaattgaatttaatgacctaatatttccatatgttatttaataaaaggtaattgaatttaataacctaatatttccatattttattgaataactctcttatatttcatgctctatcagttaacaaaatgactcatgtctgcgtacaagcttaccatatttataacaattgcaaaccagatgacgtgtactcatgtttgtaaatgcacctatagctatgcgaacttccaattctgtggaatattgattggcttactaaatctaaaaataggatagacctctaaagcatatttgtaagttgttagagatttaaaatgtaactttacctagttattagtaatgtttttgttttgagacggagtctcgctctgtcaaccaggctggagtgcagtggcgcaatctcggctcactgcaagctccgcctcccgggttcacgccattctcctgcctgcctcagccccctccgtagctgggactacaggcgcccgccaccacgcccggctaatttttttgtattttttagtagagacggggcttcactgtgttagccaggatggtctcgatctcctaacctcgtgatctgcccgcctcggcctcccaaagtgctgggattacaggcgtgagccaccgcgcccggccacagtaattttttaaataaaaacttgatagcccatggaaagagaagatgagtgggcaataaatctcagaacacatgtattggaggaaatgaatctgatgattaaactcagttcttagggcagtattgttgctgtcacaaatccccttcctggtgaaaaattgatgtggtaatcagtttcaggtcatagtaagtcagaaaaaaatacagaatttatttaggtaaaatgtttcttccctctcaaaaattgtaacttttcttttgattagtaggtaatggcatgtagaatggtcttaatgatcctaaaagctctttaaaaggtatcttggttttttttgtttttttgttttttattttttagacagtctcacttcctcacccaggctggagtgcagtggcacgatcttgtctcactgcaacctccgcttcccaggttcaagtgattcttaacgcctcagctaccagagtagctgggattacaggcgtgcactgccacgcccggctaacttttgtatttttagcacacactggatttcaccatgttggccaggctggtctggaactcctgacttaagtgatctgctcgccttggcctcccaaagtactgagattacaggcatgagccaccatgcccagccagtatcttggtttgtttcttctctttctatcctgattcagaaagcacataattgataatggcagccatcacatttctacattgaacagatattattgaatctttatggtgagctgtgctaaatgctgtggtgaatccaatgctgacagttcttaaaatctaggtgtgatgcagttcagaataaataaattcaaatgacataggttgctttgctttgttgtagttttcaaaaatggacacaacagagttcatatttgataatacaaatagcccttgtcggtggcatgatagctttatccatcttttttagtttatgacttgtggttatttttaaaacattgaaagaattttgaaaaaagtcataaatgtctgtaacactagcacttttaaggcagataatagacatctaaaatcttcagggcatggctatggctttagaatcatctgaataagttgaaaatatttaagaaatataggtctgttcatccaaagaattaaataatttgcctttgtcacgatggaataaataaaatatcacaggttatttttgttgtggtagatgccttttaacaaaaggcaatccctggagactgttgtagaaaaggacaaagcaaaacgggtgttttggttttgctttattttgattgattgttgtttgttgtcattactttctttgtacaatcacttttccatggtcaccctcttttctgctttatactaattgccctgttgaggtgtttccatgtcaaatgcagctcttgtcggaactgaaaatggcagtgccaagggagctgtgcaagtataatcaaagctggaagatttcctccatccacccgcaaccccaaggcttaagcattcccttaggaaccaaagctgactctttgggaaagttttcacagccttattaggttacaaccctgaagatgttttgttgttttgaccttaaaattttgtgaactgttttgtgaactgtgtgtgtgtgcacacacatgtgcaaaggagttgcttgcaccttgagagagtcaatttttctgcctaagtgaaaggtcaggaactgcagttaacccagagtaaaatattggttgggtgaagggctcacttctagtatagtcagaatgggctcaagatcttaggaggatgataggtgatgaactgcttaaggtaggtactgttgtgtttgtgctttgtctcatgtggacaaattaccttgttgcatatgtgagttatgtggacataaacatatacagcagttactccctgactggctggctttcttaaagtgatagtcagaatatagcctgtactgtcagatatgaaagatcaatataattgaatgaaaaagaaagctgaaggacaatccaagaataatacaaacataagctattttaaaacattagagggagtgctttatgcaaaagagaaactgaatttattgtttcattctctcttctctcccttcacccctttcaagaaaacgcaaagccacaagtgagtggttgtatgtgtctgatggcttatgtaaacatagaagaagtcttcagatggctaaaataaacatgcgcgtgttaccaaaggatatgtttacacaaaccatttgctcagcctctgaaataatgaataaatgaagattttactaaaataattgggaggatttttgtgtttctgcggatgccataattgaatggcaccaaagagacttttatcagctattttccgtgttacatgtgttagcagttcctttctgtgggttgaatacttcattctgtagttactttacacatgtttttctaagaaattgtcgtttattactgcaattctagagagttgcttgatttctcaagagaaatttagcagccagtaaaggttatttggatctggttggtcaggagagggagggcaaaaaaaaaaaaaaaaaaaaaaaaagaaaaaagaaagaaagaaaaaaaaagtgtgggggggtaatagctctcattttatccatgtaacttaatttgcataacactcacctcagccattttccttgctttgttcataacattttctttgtaaaatgtatgctctcaaaagaatgaatatttaaacaaaaaataactttcaataatgggttgcaaaccatatgtttgtattacatatatgtgtttgtgtgtgtatgcatctatatgtgtgtgtgtatgtagtgcgtgtgtatatctccacatatatgtggcatacgtatgataagggcagtatgtccttaggtaatataaagagttaacttttatttcaacattacacttagaacatccccgcgaattcactaggttagcatttcctgctctcagtttgttatcttgacacataactacagtacaacagctgggttgttcctggagttcctggggggagctttattctccgagtgctgaatttccttttcagctgtcagctctaaagtgtgttcaaatcctcaactttttatacaccattctgggcccctagcaccactctgggactatgatagaaatgctgatatggtagatgaatggaagaatctttggttcaaggtggagaattgcaaaaaccaaaatttcacatgatcattgtttggtaaaggggctgctaactacttttgtctttgtatatgaatattctttttaaaggaattactctattctcatcaaaattatttgcacctgttatgaaatcaaaaataaaaacattaccattcttaaaaatgatcttgatatggttttcacggacgcacaacatctgtggtctggcttttgaataatatgttgggatttgtcgtagttttgcctaactttctccatttataaagaaagatttgtacaacacgacatttcctttttatctaggcaaactcttcagaacacttcctaagaaattaattgtattccagccagacttgcatgctgccatcccacaggaaatgggtcagcaatccattaagatgccattagataatctaatttggaacttaatctctaaattaaccatgctccatacttgaagcgtacttgagagaaagaaaaaaagtttacgtttgaatcgataggggagccgaagcgtgaagaaggctgtttgttttttctgtagctgtggtcacgtctcaagccgtctggtaaccaggagaaaccagacatgatgtaattccagattgaacttgaacttcagggacttaggttgggggaacaatggaccataggaatcaataatgtccattttccacatgattatgtttggagctttaagttaacctttatgggagaagcagcaggatctgcagtgtgaccaaaatgagatgatcctgagacaagatgttagaggaaagaaaacaacttttttccgtgatattttctgagcaggactgcagattccagcaggattagaaaagttcccgctctgcagtaaaccggtggcctgttcagagcactctttgttcgcttaggtaggacaaacttaatcttacgtttcctgtcgatgatttttggcagcgctactggagagggaggagcgtgattctgaaaattcccaaatgtaaaccttgctgattaaccctttgtagtgaaaggaagtatattaaacccctactttatttgaatatgttttatgtaaagtgccatatttacagatgtagttcgtccgtaagaaatcagttccctcgacagccagtgcaccatttattagcttacctttttggttctcatttttgctagtgctgttagtagggatatgatgatttttttagtcatatttacttaaataacaaagactatgaatgaataaatatcataataaacataataaatgataaaagaaatggcaaaatcttaaggtcaagtaattgaagaacacgaattttgaatattctgaaattgcagaaagttacaattattctctcttgctcactttgtttcacacacaggaagatcttttgcccatgtaagatcttttgcccttgtgaacagagtagcaagcatgatattaaaatgtgttcagttctttaatcatttgtaattttatgcttcagcattctgatacaagtaagtttcacctttaagaggtaaaattgtgcaaataatgctgatttttgcttttaactgaaaatcatttataaaagaatctctttttgctttgtataaaacttatatttctatttgatttagtatgccttgggtgattttctctagtgaaaggcactattttgaagcaccatttttgtagagaattttatctgctgttaaagcatcacatatgcaaataagaggagcagtaccacttttaacaatagcattgaaaagaagcccagggtagagaggaatacagacagaaagaggctggaaatcaacatgtgggcttctccactgtgctgtggtctgtgggaggagataaaataattgctctgagcctgataattgtataatttttaattggctaaaacctcccacagctacctgagttcttatatatgtatgcatgtgtgtactgtaatttatttataattagtcatcttcataataatttttcatctttcattttcagttctaaaatttgaaaaagatcaaacaatttttttataagtccttaatttggccaattgaggaagagcttttttcttatttatgtttaaaccgaacattttaaggaagtttttatttaagtgtaggttgctatatcgaagtcttcaagtattatgtaagagttttttactaaacgagtgcagtaattataaggaacacatttaatatttagtggcagtgctcccatatggagtggctttttcttgccctgtgctctttattagataaaatatttcaatggtagatgctattattttacttagaaagtgctagcactcacgcatggtaaagttaacattcaatccactgtgccctaagaacaaaaaacttctgaatcaattgaatataaattaatgaggtttgatgggctaccattttgatatgctattttcaaaaccgttggtccccaaggagtagcaataaagaaggctatttacctacttagttaagaaacaaatatgtttctctttcattactgtgaagtcctattgcttgcagttagaataattccatgagccacctgcagtttatgatatttggtgtttcccagagagcccacaagagtactttgcagttcaggtaagagctagccagggagctttctgatacagattattacaaatagtaataatcattaggaatcatcttgcatgcaaagaggatcattccgacggcaataatgatccctaaaaacggtgaaaataaatcgaagaaacccaagacctgtataaaacactttgtgtatttcacttccaggctagcctcatctgaagtggaactcaacaaacaaattattgacatacagccacatctgcacatatgtaagacaaaagcaaatactgcattcagctgaaaagcaactggaattggaggaataaagcacagttatttgtgctgaattttgggctcaagaattatacttccacaggaatttcattgtgatatgaacctcaattcacaaagtctcttgcataattcagtgataatataacttctagtccagtgagaaaagtaaactatgcttcacaggaaggggagatgagaaaagtttagtgggtagaaatacagatcctagaatgacattgctcgaattcaaatcctgccttctacaatttaatagcaatacgagttgggcaagacacttaacttcctcgcttcagtttcctcatctgtaaaatcaggataataatggtctttctcatagatttgttatgaggattaaaagttttaaggtaggtcaagcatgtagaacagtacctggcaaataatacacattatataagtgctagcaactggtatatttatcaagtactattttctttgttctaatacataaatagattcaacttaagtgtttgttccttctactggtctgagcgagcatttttttcacaagacgtaatctgcagcctttgtgttatattgaagtaagcaaccagtccgaatgcacccatgtacaacccagggcagcacagttttcccaacaggttttcagcaattaataaggagaactgtttattgtgcattttacaagaaatgctaatacttgtgtgttaatattttgccaataaaattagagtgtttagccaaggaagtaaaaacctttccatcttggggagatcaggaaatgttgcaaaggaactaaaggcaaatgcttcttttaaattaaaatacttattttatttattccccatgctttctgggccattgctcatttttattgccatctgtaaataatgtggctactgttacagttgaggtatgtattaatatgtacaactctttgtgcttttttcctgtaatattttttaagcttcttgaaagagtatttactatcttttaagtaaatatggtattttctcatgattaaaccagtatataaattctaaatggacaatactattgttcccctgaaaaatattcgtatactggatacttagacatttcataaactgtttaactagtgtgttatctcatccattatcaaatacacacaggctagtaataaatgatttttgccattcttaaaatagctcttattgtttcatcacctccaaataaataataggtgatgtaaagtctttgactttgtttggtttctggctcaatgtaatggcttcatacatgtttaatgtggcaccctgtggttcctaggtgttagtgagctaaaaggtaagggcccaattctttttggcctagaagacacactcccataatgcataattttaaaaaaacataaccagaaaatgttggtatggctgccgagagcaatttctgcctttctttcactgaaaggtatagctctttactctttgtaggtagatgcgaagatgaactattttgcccagtttatccaggataagacatatagaaatagtgcatctttttaaaaggaagaagtgggtatcttcttccgccttaatcctcacgctgtagaactcaccctagtagaacttcaactagatttgtttcagaggagatgaatacatagaatttcagatcatttgaccacttagaccagctacatattctgtgcactagtctctttcgcaacattagctaggttataatccagcttgtatggtgcatgaaaagttcactgtctcctgaagccaattaattttgccttcagaccactctgttcaaaagttctttcttatgttaagtcatctgacttcctgtgtaggcaatataatatagtgaaatggccagggaaatcagacagatctgagtcataactgagggctaagtgggagactttgggcaaggaacttaacttgcctcagtttcctcatatgtgaaacagagatactgatggccatctcatgagctcactgagaaaattaagtggtgtagcatatgtaaaacaccaaagatggtaccatgcttatagttaagtcctcagcatggctatcgtctggaagttttgcctttgtgctgttgctacaacctgaagcatgcttaagcggtctacattcctttccacatcaactgctatatcttccctgtctacccttagctgttctgcaatgacataatttggtgagtttttcaataagtaaatgccataaagttaggttttcttccacagtgctacctagaagaaatacagtacttcagaggtagtcttaccaataacaaaatgaagcaggaccatcaccagtaatgcatcttaagctctaaataattcatttgcttcttcccttttggggggagccatgtcatacatttggtcaaaatagcaagaaaatagtatccatgatatcaaacattttatttttggaattttgatttagctcttatgtattcattttataatgaactatctcattatatgcatagtaatagtcattaggatgagctgtactttgtgttaaggtactatcaaattcttttgtgtttttttctgcttgatttttttgcaaagtaattatatcttttcttttttaaatggttatatctactttatattttctaaagatgtgctttcaactttcagctatgctcatcttctctttgcctaaacaaatgtgatttggtaatgaaaaatttgattaaaacaaaggaaatgcacacttataaagatatattgctgaagtagctgaatttgagcttgaatattttgaaatcctttcagttatattctcatttcttttattggaatgcagatagttggaatgaacataagattatccatatagtaattctcactatgaattaaaactattaagcattttacatgtaactaatttgtttttgtgtgtttattttatccatacatgtgattattgatttttatatagagttagatgtataaaaagcactattacatttttacctgagtaagtatgcaattttagacattgcatttttgaaattaaataatctgtattactttaattaaatatatttatttacattgttatctcagtcattgaattagttttatcaagtttttttttttaacaggactaccaaaaatagctctaaaaaatgtctgtgccttatagttctgaacttaaattggcaataagagacttgtaaaactcatatatggggtctgcatagtgttaatgtttgagatttatttccccccaaaggttcataaacagtattgacaaatatattgcactctgcaattttgatatggtcataatgtaggatgggcggtttgaaagatttaaataaacatttaaattaaatttggtaggcattctgcagcaagagtcctgttagttactagcatcaatttatttttattgaacattttccaaagaataatgacatatgtctcttctaaagaactgagtaagagagctattgcaaaataaaccctgagttttctgccattagttggtagacttgtccatgtaaggagccacatctattttcaatcattaaaatatactttatatccctaaagcatgcaatctccaaatgactttcttgagctcacttaatttggcactcttgttaattttgcaaagcaatttgctgcttgttgacattgtattttactgtcaaggattatctgctttacctagtccttttgcttttggtacatgcttcttacttcaagttaaaaataatgtataaccatttttgtaatttattttatttgttaagaaatagcaccagctatgctcagactctataaagatagatgtgactaggtcgttttctctgtgaagttcacctttcagttagtaagataatcccagatagagatatttatgaagtaataaatgctgtaacaggaccatgtacaaagtgcagtggaaacacagttgagggtaaaataagtttcatgattcattatgtaacattgttcccaatcaatggtgcaaagcacaaaaataattgttgaagatgtgtgtgggaagagaaatatgtgaaaacagttaagctgcttagtaaaagtttcaataacaagtattcttaagagttacgatttttcatcagattttgaggacgtgtctttttagtttgaatgtgattattcctgcttaatcaatttttgttaatgctaagtagatctaattttaaattcagagatacctattttctttttataggggatcaaatcacaacatattcatgagtatatgtaatcttgggtgacagcttttgaaaatatatagctgggtgtgatttgaaacaattaattgatttgtttgtctaaaaaggtattgagcatcttccatgtgctaggtactttactagagacggactttgctgtcattgagtttgtagtctaattataaaatcccttgagcacaaatggtcgttgtgatattgttttgaaatgttaactcagaaatatgtatgtgtagcaacaagcaacattttgtatcgaggtatcaccagagtaaaaacagtatgtatcaagttttaaaaaaaattcagaattgttcctttaggttgatattctgtaaaggtttttgtacttttggaattcaaatatgaacaaatgagcatatctagattgatagctacaacaatagtgctatctcacttcatggtttcaaaagtaaagcaaaggatgttcagtgaaatttaaaacctcgaaagtatgtttccatgctaggccatgactaatatgagtactgaattgtcagtttgatgttttcttggttcatgattatttatgcagctgttacttaactgacattcattcggatttgagtgttggaacaggcaatacattagattaagtgtacccaaaatgtgtgctgtagagttgtttcatgatatgtagatctgattttttttatcctccatatgatactttttaaagggagattatgctagtagcaattagagaattgttttccagtcttttttttttttttttaacagcctgtaattcagcataggcgaaagttgaactgatgagagtaaggctggaatcttatcatttactgcctccaacacccccaacccccaacccgccatctatcactccaaactcctcacgtgcagagcagctcaaatgtggtatcattactgatggggaggagcaggaaatgctcaggcttctgttgcaagccaatgtagggaaccatgaattggaaggaaaagctgtggctctctctaaaagtaagttaaagagggttagaataagaaaactgctggagagctatagaactaatcagtgcaagcagagacctttgtggcctcctgtaaatgtttttcctcacgatgggtattctgtagagaacaaaaaaagctgtgttccattttggttctatgattcttatttgttcggtctttactaaaaaactctgattaaggtatgtttgataattgggcatttcaaattgtatgttatgcatgggcctaccttaaacatgtagttttttttcctgttgtaaggagaaaagaaatatctttcaccgtacttttcaattgtattcaacccaataggcaggtaagaaattgaaacccatctgaccactgaattgcttgtgaattaaaggtaaaataagattagaatgtaactggcaaagtatattggtaccaacagattgctgcttttctttttcttttttttcctgtacaaaaaagaatgatattgcatttatattgaataatgtaaaatattttagaatatcctcaatcggttagaattcaataattgtttatatatcttactctggatttttctgcctcactttagtcttaattttcatttaaaaaatagactatagagtttagataggtgtaacatgtataatttggcacatttatctcatattagactgtaattttgaaaatagggatagcaataatttgatgcatctggaatttatatttctcatattgttgtagattttaacattgtatttttttcttttttcttccctccctgctgcctctctcctctcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttacctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaa

SEQ ID NO: 14430 - DNA, 5699 bp, Human; identical to SEQ ID NO: 12445

SEQ ID NO: 14431 - DNA, 17023 bp, Human; identical to SEQ ID NO: 12056

SEQ ID NO: 14432 - DNA, 34172 bp, Human
cagtcactgagcctcagtttctacatctgtaaactggggatagtagcatggccctatttaatgtgctcagcgaagccactgaaaggagacagaaatgtaccagaattccctggacttttatcctacttctcctggggattgtcacccacctacccgtgtctgtcctttgttgctttgacgctgtcacttcttttcttaggtacctctctgtagggctccattattccagggattccagagttacagcacatgcatacctccatccaagcatgtttatttgtctcctgcttcactaggctgtccccaaggaacatgtggctcccggcacatacctggcacaacactgcacatgacattcacccacttggccttgaatctgacaaggaatctggcatgatgttcacctgctgaggccaggtgccgagcagccctggaggcttaggggccagagggatgggaaaaggtgtctttctggggtgagtatcagtttctgcaggagtgctgaacctgagaaagaataaagagagaaggaagtgaacaagcacagcttaaacatcatctgtttctactgagttttaacaactctgagattttgtttgtcatggaatccatttctcaggccaagcagacacagaacttgggtgtgagtgatgataatgagctgatataattttcacaccctcatcactgagatctctcccatcaggaatgggtcacagggctcacaggtggcagcaactgttattacaggcctcatctctaccagctcctggcacctgctctcctcccattagaaaatcctccacttgtcaaaaaggaagccatttgctttgaattccaattccaccctcaagaggctgggaccacctcattggagtccttgatgctgtgtgacctgcagtgaccactgccccattgttgctggctgaggtggtttgggtcaacctggccatctgggcagctgttctcttctcttctttctcccctactgtttccagacatgcagtatttccagagagaaggggccactctttggcaaagaacctgtctaactttctatctacggcaggacttttgaaagctacagaggaagaagcacaaattgatgctattccactaagccatcagctccatctcatccatgccatgtctcttttttaggggtcctcttgccaacagaatcacagaggacaaatctgaaagtgcagagacagcagctgaggcacagccaagagctctggctgtattaatgacctaagaagatggagtggtcaccagaaagtcagaggaagtgacacacaggggcccagcaatctcagccaagtcaactccaccagcctttctggtccccactgtgtgtacagcaccctgatagggaccagagccatgagagtgagtaagaccagactatgcccttgaggagctcacctctgctaagggaaacaggcctggaaacacacaatggtggtaaagaggaaagaagacaatagaactgcatgaaggggatggaaagtgcccaggggaggaaatggttacttctgtgtgagggggttggtgaggaaagactctaagagaaggctctgtctggctgggtatgaaaggatgtgtaggagtcttctagggggcacaggcacactccaggcataggtaaagatctgtaggcatggcttgttgggatgagtttcaagtattctggaatgaggacagccatagagacaagaggagagttaatagattttatgccaatggctccacttgagtttgtgataagaacccagaacccttggactccccagtaacattgattgagttgtgtatgattctacatagaatattaactcaatggaggtcagtgagtggtgtgtgtgtgattatttgccaactgccgaggtggagaagcctcttccgactgcaggcagagcacgggggccctgctactggctgcagctccagccctgcctccttctccagcatataaacaatccaacagcctcactgaatcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctgtgagtaactgttcaggctcctcttctctgtttccttggacttggggtgctaatcaggcctctctttcccttatctgttttgaatagcaaaaaggatgttcaggctggccgtggtggctcacacctgtcatcccagaactttgggatgctgagcaggtggactgcctgaggtcaggagttcaagaccagcctggctaatatggtgaaaccccatctctactaaaattacaaaaattagctgggcatggtagtgcataactgtagtcccagctacttgggtggctgaggcaggagaattgcttgaacctgggaggcggaggttgcagtgaactgagatcatgccactgcactccagcctgggtaacagagtgagattccatctcaaaaaaaaaaaaagagaaaaaaaagaaaaaaaaagattttcaaggagaagtagcttaagtgttggatgctacaaacatatagaggttatgatggatgttttgcagatctataaaggaataaataagcatctcccccattcatctttagtggaaagaagggtttagggacagcattgattaaggataatctaatagacaatggtttgtacccagcttaccaaaccagaatttggattttacatttttccctttaagttgcaggagaagagggtgaatcttctcaccagtgagatcctggcatcctagagcaggtggagagaagagtcactccctactgtgtgtactggaggcttcccgcctgtcacattttacttctaactcaatttcacagttattaagagtaaggaatcatggtcacatggaaacagaaaatacaaacctcgttttaattctttcacagaaaagttagcaattcagtgagttgtggtaacatagtttccatctactggcaatttaacatgaattggtgtggcttaaattcatcctttttaaagccagatttttttggagatagactatttccagcatgttccttctgagtgataaaagagggctattagttcagtatttgtgacaataaatgtgtataagataacctcacctttccagaataatgtcaggaatatgagtctaatgtacaaatatatatctctaggacaagactgcatatgtctttttaaaaatactttcccaagagtttattttaatacccccatttcaaatacacctgcttagcaggttatcctaaactctcagggctagaaagtaagcaagactgtgagccagtgatgatagcaaaagcatccaggtaggatcaagatgaagtgagaaaatattccttacccctcagggtagaactccaaatagatattcatgggtcctggccccctagtggaggtcacttgaaggacaaacatgttggcatctcatctgcttgaagcctggacacaagggcaccatcagtgtcactctgtgtgtggctggccatgttgtggggctgtcactacagattctggcagtcaggcagacaataccttagccttagacgatgccggtacagcccaggattcagaagctatagtgtagaccatgcccttcttaggcctatacaattacatgcaatagatgatggatttttctgttagcctcttcattgtaaccaaaagcagcattactctaccaaacagaggggagctggaaagaaactaaacagtttgccaagcacagcctctgccttgacgtggaatcatgtgaatctagacactcacctagatctttcctcgggggccaatgctgctcacacattaactcaatagtttgtcctggcctgagagatcatgtaacatgtagaaagtttagaagcagagattagtgccattgattttccatggctgtgacaacaaaggaaggaacaggagtgggaaaacccaaggccaccctggttgtggtagatggtgcacacacttccactaactattctggggcaaggatccaaatgcactattgggcctggctatgctgtctctgctgggttctccaaacacgagcctccatgctgtttcttagttgtattttaccacatattatcagagtcactggatttgtacagaatgtttggaacctatactgccttaatggctaccctttaaagaagagaaaacaaggtcttaattcaactatctggaacattttatggttacttatgtggaatactccatcttttgctatcaacaggaaggtacctggccattagaaggtgcctgcctttcagctgaaagcacatatgaggcatatggatccatttatacacaccgtacttttgaaccacattttcctaatttgcctgtctggggccaagcttgtgggactagcagattcatggttgaattgatggctggctacctcttccatcaacttttctgcttcatccagtcttccacccctcagtaacctcaaactgggaaggtcttcagatatccagaatccccagttggggaagtccatacatggcccatcaaagatgggttgcaagcaggcctgctatagggagcagcagccttgatgggttttcctacagagacagttgatgtgcagacgcaataaactgactgctttgtaattgatcaccttgaaaaaaaatgagcatgtctggctgtattagtcttttcttccattgctataaaaaaaaatctcagggtgggtaatttagaaaggaaagagatttaattggctcatggttctgcaggctctacaggaagcatagcgacttctgccgctagggtgccctcaggaaatttacaatcatggcagaaggtgaaaaagaagcaggcagatcttacatgactggagcagaagcaagagagggtggggaggaggtgccacacacttataaaccaccagatctcataaaaactcattgtcaagaggacagcacccaagggggatggtgtgaaaccatgagaaactgcctctaagatacaaccaccatctatcaggccccacttccagaattggggattacatttcaacatgagatttgggtaggggcacagattcagatcatatcactggcactgtgcttatcaggtggatatcaccagttggaaggctagattccacaagaggaggaatgtccttgttcttagttgtgattcttctgcacagtgtcattcaggaaaatatgagtcaatcatcctccccaatagctcaaatcaatcagatcctctgaccacagagactgaggtgtagctaaaaggtgctcgcacttctacgaggccaatggaagcctggagcacagttgtcaatctgtagaaataaggactctgtgactcctccaagacctctctgtgaatgacagtttaagaagggccagatcctaaaacagggtcagagcttagagtgaagggaaagcttaaaagcctctgagcaaattctaaagacagggtcaccataggctctcagtgaccccctgtgactgagtggatgcagtgatgcaaaatctcatcatcactgcagaagacaaaagaaaaattgtcactctttctacctaggatgagaatcccaaaatcagggaagagtccacttactaaaaagacatgagggaatgaagtgcctggaagaattcgttcctgaacctctcaggatcattcacatttgagaacatttatcaaatattcatcccagactggggccatgaagacttcagctgcttttagctaatcattgtaactttttggtgtctcatggtggaagcatgaaaggacctgatgaacaaatataatcattgccgtcagagttactgttattttttattgccttaatgttacctcctttgcctgatcattccagttcctcagtcagtgactcaccagcccctatatctataaagtcacaatccctgagacctgatttttgtttcactttgtagatatggaacccgtacacatggactttttaagaagcttggaattccagggcccacacctctgccttttttgggaaatgctttgtccttccgtaaggtgagtgtttttgagcttcctcttttgcttcttatgattgcaaagagcaacttagttccatcagtaaaaatgcttctcctcaagaggaaggtctgagattttatactttcagaaatagcgtgtaggcatcacccagagcgtggcaaagtttaccctggggctctcttgctaactctcaggaacctcaagtttgcctcagttggacagcccaaatgtcaagtagatccagcaatctgatgttcacaacttgatgtgcagactttgtgagcaccataaagagcatttcctttttgctccaggcaggttcccaggaaggtacagccatacttagttagtattaaaagtaggaacaggagcccctgattgtggcttgttatctgtggacatgagagtaaaactttcctctctgtagcaagagctcatgaataggcttttttcccttcctcctgcacagcttggaaactcagtttattagggagatcaagtatttaccattgggtcatttgcacctgcttgaagcctcttcaaaaaatgccaaattttgttggggaatttccatggctttaacccaggtcttactccccatgacatctgttgccactttgagacacagaacaaaagtgttctgctttacttcttttcctttgaaggctgcgtcttgtgggtgagtctgagcagggagtggatgtaactgagatgagatagtggttgtctattaacctcagatatttaagcacaatatgaattcatgggtttattttttacacaaaggcagaatcacatgcaaaatcactagaaaggggatgatttgacaaaattattgaatatttaatttcactaaatagaatgtcatatgtgcctcatggactggggactttggtcgagcctttgtgcctaaccttatctgatgctgtgttcagggcctggtccctggatggaaaattatgagcttatttccacagggccagcagcagcaggagtcagctctctggcttagacaatctgacctgcatacctgaggcttgtttctcagattctagttctcctaagtgagggctttgttgtctaattactgcccaggaatttcatattttttccctctgcaaaagcaataatttccctactttcacatgcgtccgtgtgaggagaccaccaaacaggctttgtgtgagcaataaatgtttttaatcacttgggtgcaggccaactgagtctgaaaaaggagtcagcaaggggagataggggtggggcagttttataggagtggggtaagcagtggaaagttacagttaaaggtggttatccattgtcagcagtggagggggccacaaggtgcatggtggggagatcataagactcattgtgcagagaagaatgtcaccaggttgattgatcaatcagttgggacagggcaggaacaagtcataatggaatgtcgtaagattgctcaatcagttaagacaggagctggctgtttcatttcttttgcagttttcagttgcctcaggccatctggatgtacatgtgcaggcttgggctcagaggcctgacattcctgtctttttatattaagaaaaataaaacaaaatagtggcaaagtgttggggcagcaaaaatttttggggggtggtatggagagataatggatgatgtttctcagggctgcttcaagcgggattatgggccatgtggacaccttaaagaaaattttataatgagttacaaggaataggaatttaggctgtggggagatcttggggcagaggatggtaccatggacttgttaaaagtaatatttgttgtatagaataattggtgatagtctgaatgtgtttttatattaattgagaaaccaattgaagacacaagtcccgaataacagaaggagaaaaacaggtaccagaggactaagaatagggaggagctaagacacccagttagaaagtgtccaggtgggtccaaaataagtatttgcctggctggtgagtttttggtctttatctttaagcttttttatattgtcatataccaggccagattggtttagataaaaacaacattcttcatttaaaaatatagagtactcctttttcagcagtgagtaggtcaaggcctcagcgatgttggaggacgactagggctaagaagtcaacctgggtctgaaggactgataaagtttgtgatgtatctgtaatgctagcagaaaagtcattagaaaggctacagaaagttgtgacagaagttgaaatacctgctattccagctccaagggcaatagtggaagcagaaagtcctaaccctacaagtagagggattagaggaataactcatttttgtctggttggtgtcatgagggggacaggaagttgttccgtcccatttgcaaattgaattttttcaatttgggaataagaaatactagtgtacatgtacctgtccaattagcagatagacatatgtacgtggtggagccacagaggaagcagaggccttgtgtgaggcaaaactggaaatgcaaagtgaaaagatgagagggagtgccaaaagaggtgtcttgcacccagactcttagggatttagtgagggcatcagcccttagtggtcataatggggattgatggggcaactgggtatgagaaagagcatagtgtctacaaccaaactttcattgctattcatggggttcggtataagtaaacaagaagggggaatgggaggagagtctgaagaacaaggggaaggtagccaagaatggagtgaaatacagggcaaatgtcttaagggaaatgagaagttctaagagggggctagttgcttgtaacctacatggaagaggtcatgaaatgacaacagaatagaatgggcctgtgagactggaaggagatatttttcttggtctaagaaccatcttccttgagtggggagggattgatagatggaaacttcagtgggagagtaaataggagtgactgatgagaaggagaaaaactggccatgagggacagaagtaggaatactggttgcttctttagctgtcttatcagcataattgttgccttgagcaatggggtctgaggccctttgatggcctttgcagtgaatgactccagctttttttggaagtaaagtggccttgagaagaatttttattaaagaggcattaatgatggaggacacttgcatagtgaagaaacttctttcagcccatattacagcatggtggtgcaggatatggacagcatttagagtcagtataaatattgatgtgtagtccctttgcaagagtgaggccccaagttaaggcaatgagtttggcttgctgagagatagtggaggggggcagagcagtagcctcaatgatagatgtggaagataatatagcacagcctgcctttgctggtgagtggtgattaggcctggtggaactgccatcaataaactaactgtgattcaggtgaaaaacaggaaagaaggaaatatggggaaatagagtgaatgtcagatggatcagagagatacagtcatggggataaggtgtggtatcaggaataatgtgggaggccagattgaagcccaggccaggtacaatggtaattgtgggagactcaacagagagtgggtattgctaaaggagctggggaacagaaagtatatgcatcaggtgtgaggaaggaaatatattttggaagttatgagaactgtatggagtgagttgagcatagtttgtgattttgagggcttctaaaagtattagggtggtggcagccactgcacagagacatgatgaccagcctaaaacagtaaggtcaagttgtttggacaaaaaggctacagagcacggtcccagtccttgtgtaagaattccagctgcacagccctgcacttcggctgtgtgtaatgaaaagagttgggatgagtcaggaagagctagtatgggagcagcctctagagctgtcttcaaggaatggaaagaggagtgaggaaaggatttaggacttatggggtcagctaggtttccctttgtgagtttatataatggttttgttaggatggcaaaaccaggtatccaaaggcaaaagtatccaaccatgcccaggaaggaaaggagttgttttgtagaaggggttggggtttcagagatcagccagacatgatcagcagggagagcccatgtgttttcatgaagaattatgctgaggtacgtaacggatggagaagaaatttgagctttggagggggatacccgatatcctttggagagtaaatgttgaaggagcaggagggtatcttgttgaaaagactcaaaggagggactacagagtagaaggtcatcaatatattgaataatgtgggaagcagagggatgggaagaaagtaaatcatgagagagagcttggctgaagtaatgagggctgtcccagaagccttgtggcagtacagcccaggtaagctgctgggactgatgggtgtcagggtcagtttaggtaaaagcaaagagaggctgggatgtgtggtgcaggggaatagtgaaaaaagcatctttaagatcaagaatggaatagtgagttgtggagggagatattgagaacaaaagagtgtacgggttgggcaccacagggtggataggaaaacaattttgttgataaggcgcagatcctgaacaaacctgtaagacttgtctggtttttagacaggtaagatgggggaattataaggagagtttgtaggctttagaagcccatgctgtagcaggtgagtgataacaggcttcaatctccttaaagcctcttgtgggatgggatactggcgttaagctgggtaagggtgattaggctttaatgggatagtaatgggcatgtgatcagttgccagggagggagtagaggtgtcccatacctgtgggttaaggtggggggatacaagaggaagacacgaaggaggctttgggttgggaagaaggatggcaatgagatgtagctgtagtccaggaatagtcagagaagcagataatttggttaaaatatctcagcctaataagggaactggcaggtggggataactaaaaaggagtgcataaaagaatgttgcccaatttggcaccaaagttggggagttttaagaggtttagaaacctggccgtcaatacccacaacagttatgggggcaagggaagcaggcccttgaaaagaaggtagtgtggagtgggtatcccccctatcgattacacaggggatggacttaccctctgctgtaagagttacctgaagtttggcatccgtgattctccggggggcttccgaggtgatcgggtagcatcagtcttcagccactaagccaaggagatctgggaaggagtcagccaagaaacattgggtttgagctccaggaactttaggagcagtggcgatgtgagtcagacagtccaacctctaattggagcccacacagacagggcacggcttaggaggaatcccaggctgtgggccttctgaggcccagtggccaggcttttggcatttgaagcaaggtccatgaggaggttttgaaggagcccctgggagctgtggcttggatgttctgaaggttttgtatgctggagacatggtcgtgggttgtcttacactggaggcaagtagctataattcagagatgcattgtcacttggccgcctcttctctattatgatacaccttgaaggtgaggctatttaagtcctgttgtggggtttgaggcctggaatccaatttttggagattttttctaatgtcaggagaggattgggtcataaaatgcatattaaggataaggcggccttctggcccctctgggtccagggctgtgaagcatctaatggtaggtgctaagtgggccatgaactgggctgggttttcatctttaccttgggtagtttcctttagcttgtcataattaacagccttgtatgctgcttttttgaaccccttgactaggcaggagaccatgtaatctcacctagctatacctggggagtccatcttgtactgccaatggggatgctcttggggaactgccctgatgccttcttgaaggtctggctcatggcactggtgggtgtcagtgtgagattgggctagggtatcaactctttcctgctcatctggggagaggggggaggtcaggatgacatttcagtcactccaggttaaatcgcaggactgagttaaatattggaattcctgtatatatttagtggggtctgatgaaaaagagcctaaacgctgactgatctgggagaggtcgatagagaaaaaggcacatgtaccttgactatgccttcagctccagccacctgactaagaggaaattgttgggcaggtggaggtgggctagtctcggaatgaaactgtaaggtggagtgggtgtgaggaggggaggtgatacttctattatagggtgggggagcagaggatgaggaagaattgggacctggcttggcctggtgaggagcagcctggtggggaggggagaggtcagatgggttcatagaaaaggaggattcaaaggactcagagcttagggtggagactgaagaaagagacaggagagaaagaagaaagatttgggatgagtcacactgggagcagagactagggagagactgatgtataaaagaatgcctggatgtcaggcacctcagaccatttgcccatttttcaacaaaaatcatccaggtcttataagatcgagaaatcaaaagtgtcattttctggctatttggaaccattgtccagtttgtattgaggccaagcggtattgcagaagaaaataaggcatttaggttttaggtcaggtgttagtcaaagggggttttaggttttgaagaacacaggctaagggagaagaagagggagtggaggctggaaggttgcccatagtgaagggggcaagcccagagaaaagagaaggtagagacatggagagaggggggatggtacttgccacccagggaaggtggtgcttgccacccagggaaggtggtacttgccacccagggaaggtgatacttgtgacccaggggaggtggtacttgcgccaaggtgaatgatcaaggcaggcatccccacagtgatcagatacctctgaaatgtgggtgaataaccaggcaggtgtcctggcagtgatttagacaccaagggaagactgttcccgagtccatgactggcgccagagttttgagttcatggataaaacgtatctcctctgtctctaccagaaagggaaagaaactgaaattaaggaagggagagattgaagggtggagggatagcaagagaggttggagaagagaataaaaagaggccgcttacccgatttaaaattggtgagatgaccttgggctggctggtctgaggacccaagaggtggatctccccatggagtgagggcgaggacaggggatgggactcccgaaggagtccccctgtcccaggtctttggcaccaaatgtcatttgcgtccatgtgaagagaccaccaaacagtctttgtgtgagcaataaagctttttaatcacctgggtgcaggctgactgagtccgaaaaggagtctgcaaagggagataggggtgggtcagttttataggactggggtaagcagtggaaagttgcagttaaaggaagttatctattgtcagcagaggagggggtcacaaggtgcatggtagggagatcataagactcattgtccagaagaagaatgtcacgaggtcgatcaatcgatcagttggggcagggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggttttttttttaagtttcagtgcaaactcggagcaagtgtcataattttctgtctccgatgtgtagaggtgacattttctcagaactttcacgttaagctggaaaactggaaagcgagtccactttgtcattctgtcactcactcattttctcactcaacaaacatgcctcacacttatctaaatctgctagactaaaagaggtccctggtgtctgtaactttctaattctgctagaattctagagtgagctcatgaaataaatgaaaaggatgaagaacaaagagaaaaaagactgcacgttcccttctggcgctcactcacattccctcagcctcagtttctccacatgcccctagaggtgatcattcaaggatttatgagattttagagacaacacatgaaaaagcaaagagacatcagaaagacaaggagttacttagtatttatacacaaggataagacattcagtatcgacaacacttaaagaaaattcaagagtgattttaaatttcccatttcaaatacctcctctattttgtttcctttctcttatgacatctctaaataagcttcctctaactgccagcaagtctaatttcattggatttgactgttttcaaccccaattagaggcagggttaagtacacttaaaataataatgaaatattattttgtttctcctcccagggctattggacgtttgacatggaatgttataaaaagtatagaaaagtctgggggtgagtattctggaagattccattggatagacttgtttctatgatgagtttaccccactgcacagaggatagtctcagcccagagcctcttgcgatgaagctcttgccagcctaactacaaacagagaggttttctgaaagaagaagatatgtatttgggagaagagtattagaatgggaaactgtgtgccattataagctatgtgcaaattcagggaggtaaaggaagacaaagatgttccacagaaaatatgaggaggacttcatgtggattttgaaatagttctccttcactacaaagatcagtaacaagggtgatgccacaccaaggttggacaggcagttgctgggcaggtgtccttgcagaaatatttttgtgtaaggttgggttgggctttctgcaagctggtggttttgccaagtattttgtgatagttttgttatcaggcacacaagcatgagaatccactcatcatagccttctttgatttatttgtcaaggtttttaatcacacacataggcacacagacacactgacacacacacacacacgtgtcataattttggttctcacaatgttcacactcgctattgtaaaacaactttttgagatttgtcctaccaaggatcccatatgtcaccaggtgttgaggtcttcggtctaaactaggctgagaccattgtggttaccacttttctccaagctttggtggcccagggactcccagcatcacgttctgtccagtgtctgcctattcccttcttctttttttcttcccttgatgcccttttatcacatgcattgtctcagacccttcgaatatgtgctcataaatgcatggcatcatctccttcccacatcgattcactttcaattaaaagccaaaactctttcatttcaactttggatttaacatgcttttgaaagaagggttgagaaatatagagaaacagattgggaaaccatgctctgctgtttcttttttttaaactttctatgtaagtgtggaatttttcattctgttttattattaactttaagccaagactttttaatagaaggatatataaatacatctttgtctatacatttctgctgaatttgaagaaatgctgaatattcttaaaccattgtgttccctggtgggctgatggactgtgattttataaggtggcctcagccaactgcagcagctgttccctgtcagaggggctagaggtttggcaagagcggtggaagaggtgcagtggtgtgttcgttcactagaagcatcagggagaaggttttgcctgtttgtatttcatcttctctcatcaagtcctcagaaaccacagtgctgtctgcagggtgctgtggatctggcatggcccatacaggcaacatgactgagtagaaaggacacacagctctggatgtccttgggccccacagcaactgcccttgaaacatttagtccttgtgagcatttgatgatttacttgccttcaattttccatggacctaatactctttataaagggaaatattttaaacctatgaaacattgtggagaatggcatgggaaatacccatgtatgcaccacccagcttaacaaatgctctcctgtcatttctaaccacaatctctttgaagagctcttttgtctttcaatctctcttccctgtttggcccacattacccttcatcgtatgaagacttggatggctcctgtgtcagactcttgctgtgagttatacctaatgaactagaacttaagattactgtgtattgtacatctagaggattatgtaatgtccggatcaaagtctggcttcctgggtttggctccagctgtagcataaggctgttgatgtttaatcaactctgttttctccacacagtatttatgactgtcaacagcctatgctggctatcacagatcccgacatgatcaaaacagtgctagtgaaagaatgttattctgtcttcacaaaccggagggtaagcatccattttttgaaattaaaatactcattgattgattaaatttttattttaaaattcttatatattcatagacagttgcctaaaaactgtgcaggaaggttccatgtacacttcatcctgcccatcccccatggtaacatcttgcaatcttgcataactataaatacagtatattcacattactgcagtacaggaaattaacattgatacagttcacagagtttattcagatttcaccagttttatgtgccctcatttgtgtgggtagttttttgtttttgtttttgtttgttgtttgttgtttgtttttcggactgagtcacactctgtcacccaaatgggagtacagtggtgtggtcttggctcactgcaacctccacctccagggttcaagtgattcttctgcctccacctcccgagtagctgggactacaagttgcaccaccacgccctactaatttttgtatttttagtagagacgaggtttcaccttattggccaggctggtcttgagtgtgtgggtagttctatgcaaatttatcacatttgtagatttgtgcaatgaccagcatgatcaagatgcagacccattccatctccgtatggctccctgctactatcctacagtcacgagtgtttttctctgagagggtctttatcagggaaaactttttttattttgaggaggccaatgtattaatattttttttatggattgtgcttttggtgtcaagtctgaaagttctttgcctagccctccttcctatattgccaatttttctaaaagtcataaagtttaatgctttactaaatgtaactctactatctattttgtgttattttttgtataaggtatgagatttagatcaacgttcattttttgtggcttgtagttgtccagttgttccaaagccatttttggaaatgtgggcatattgttaaaaattaattgggcatgtttctttgcatctttcatttgctattctgtcccattgatcactgtgcttattcctccaccaacaacaaactggtgactctaatacctgtacagtaactcttagcatcatgtagagtgattcttcccacttttatggatgtattttttcagatttgttttagctcttcctggtcctctgcttttccataaaaattcagaatgagtctctcagtgtctataaataaacatgctgttattttaacaagaattgaattaaatgtatagatcaatttagggaaagtctttatcttcactatgtttggtctttcaattcatgaacatagtatgcctctccatttccttagattttctctgattgcttttagcaatttgtagttttcagcatagagatcctgtgcatgttttgttggatttacagctaaagtatttcatttttgttggagtgattgtaaatgatattatgtttttcttgtattttcagatattgattgttggtacatagaaacatgcttggcttttgtttgttgatcttgtatcatagaaccttgcagagctgacttagtatttctagaagtctttttgtatattcttgagattttatacattgacaattatgtcacttgaaaatagagacaattcttttatttcctttccaatctgtatgccttttaattctttttcccagtataatgtcaaataaatgtgttgaatttttgaattgttcctaatattaggaaggaagcatttggtctttcatcatcaagaatgatttagatgaagtgggtttttttgtagattctctttatcaaatggaggaattttctctccctagtttgctgaatttttaacataaaagagtactgtaagtactcattataaaacaaaatatggctgtggaagatgaaagagagtttcaagcatgctggcttgataggccagatccaagctggcaaaaataattatctctttcttctttttttctatccatggaataaaaaattaagaggaaagaatgttaatagaatcgcattatttcttcaaaatacgttgtgagttttaaaagtattatctaccttttttattatactttttttagggtacatgtgcacaacgtgcaggtttgttacatatgtatgcatgtgccatgttggtgtgctgtactcattaactcatcatttaacattaggtataactcctaatgctatccttcccccctctccccaccccacaacaggccccagtgtgtgatgttccccttcctgtgtccatgtgttctcattgtatatttttttaaatctaccacatcaaggcacctctttttcatgttgcccatggtttaggtgaacataaagacagagctcgtctgaggcaacatacagtccaacaaagccacctgcctctctgtctccactctctctctacactgcacgcgtgctaggtgttgatcctgtctattccagtggaagaacaggttccgtaccatgtggagaatttgcatgtaaaaggagactgggatatacaggctggagaccacatcaggtggctgggcatgtgggataaatcctattgagcatctgtcatagggcctgtcacttagtagacagtcactaaatatttgttaaatacatgatgcctgtttaacacattttctacaaccatggagacctccacaactgatgtaggacaaaatctttctgctttgaactctagcctttcgggccagtgggatttatgaaaaatgccatctctatagctgaggatgaagaatggaagagaatacgatcattgctgtctccaacattcaccagcggaaaactcaaggaggtatgaaaataacttgggttttaattagaaacttaaagaatgaatcaggtggggacaggtagaaagtaagatcagagttcctttccgaggagtagtctgctgaatttgagcttcctaaaaatagtctttttatgtacagaaaacacatcataaaattcattacacaatgtcacttattgttccatgccaggcaaagtcatgtccttctgggacttatgtctgcacatttaactatgggtggtgttgtgttttgtgcttagatggtccctatcattgcccagtatggagatgtgttggtgagaaatctgaggcgggaagcagagacaggcaagcctgtcaccttgaaacagtaagtaggagcacagccatggggttctgagctgtcatgagcccctccagctgcctgctatggagctgatactcccgctgttgggttattccagtgaccagacaaaaggagggctgtggtaatgcaacttcaatgggtctcccaagatggggcagctccgatgaggaggtggggcagctggaggaaaaggatcttctcccctgtgcacagaggtcagggtttacatatctgttaaattgtcaccttggatattctggaggactaaatacatcctttagggggaaaagtgtgattgtatcaaagttttaagcatggagtgtatgggatggtggaaggggaaggcacttggtatctgttggttggcagtgagtagggtgggaaagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgccatcagggcaacctcagctcaccacagctggggatagtggaattttccaaagcttgagcagggagtatagagaataaggatgatatttctaggagctcaggacatggtactgttgctttgtaaagtgctgaagaggaatcggctctgggcatagagtctgtagtcaggcaatgtcacctgtcttgagccccttagaaagagtgaatttttctactcttgttctgctgaagcacagtgcttacccatcttgtatcatccacaattaacacatgctactgcagttgtctgatagtggatctctgtctttctatgactaggctccttgacctcagaggtaagtctaactcagttgagtgtctccatcacccccagcggagagccagctgtgtcactgacacctgataatcaccttctgagggagtgtgatgggagatgctccagtaaatagttctgaaagtctgtggctgtttgtctgtcttgactggacatgtggatttcctgctgcacgcatagaggaaggatggtaaagaggtgctgattttaattttccacatctttctccactcagcgtctttggggcctacagcatggatgtgatcactagcacatcatttggagtgagcatcgactctctcaacaatccacaagacccctttgtggaaaacaccaagaagcttttaagatttaatccattagatccattcgttctctcaataagtatgtggactactatttccttttctctccctctctcttaaaaataactgctttattgagatgtaaatcaccatgtaattcatccacttaaaatgtacagtttaatggtttgtagtacatttgaagatatgtacgaccatcaccattgtaaactttaaaacacttctgtcattctagaaacctcatacatgtttagctatcaaccccctgccagaaatcctgttgtcgtatataaccactagtcaactttctgcatctatagatttgcctattctggacacttcatagaaatgatattaatttttcagggtttttttaattctctagttcatgaatttgtactttagtctgtattattttctttcttctgctggcttcaggcttagtttgcccttctccgtttactgtgttgtggcatgaatgtagattattgatttgtgggtttttttcctctaaatttagacattacaactataaatttccctctgggcacttgtttgctaaataacatgacattctggcctatcacatcttaatttttgctcagctcaaaacagtttctatttgcccttttaatttctacttcaacttattggttgcttaaaagtttattgtttaacttccacgtatgtgtgagtttcccaattttcgttaccttattgattttagctttatcctatgataggtgacagagatacactgtgttatttctatctgatttcttgaacagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgagaatgagtcagagagagcacttaaaatttgatatcaggcacaagaattagtatgccatgacataaatattattcagataaaaccttatcacagcacttcccttcaataaattgtcaaaggataaacattactgtttggaaatacattttattggtattatgctttctctagatcatagattggtaaagagtcatttcaagtacaaggctattattttacacattctccaacaaaaggtcctatcaggccacctgctgaagtgtagtgtgtgttacatttgagccctctgacagcctcgagtgaacagaggtcttctctgggaattgaggctgcaaggctggctaactcagctttgccttcatgagccctggagtccagccaaaagatatctgcaggtcaggggggcaagaaggggtaacccaggtgtcactgaagattgtatagatttggggaatgttgcagtatttgaaagtgctcccaccaaagctgctgacaagttctggaaatgtcaggagaataatctttgtggacattggtgatgaagaagacagaagaataaaaggcccaggacttcttcatgggtatgcagttaggaccagggaaaagaccaaaaagcaattgaacattttagccagatttgtttcaggaaaacatcctgctttccaaggatttagatggatattccttttcactggtgactcaggcaacacccatcagatttctggtctccaaggggctatattctcagaagggaggttgaggactgcacttctgattaacttctgacttcacgagtcactttctgtcaataaaatttctctttttgcttctagcaccgagtggatttccttcagctgatgattgactctcagaattcaaaagactctgagacccacaaaggtaacaaaagagtgcttctgagggctactggtggggcactcagagggaaggttttgttctgaaaatgtgcaggaagtattccaggtagatgagaatttctgccacatagcagaatgacacaggtttggatgttaaaatggtagctggaggcaacttctagaggcatgcaggcatagatagccatgttctaagcttaaagggcaaccctaaggaaaactggcatgccaggaagagtcagcagtctgtggatcacctacataagatcaaatgccagttctcagcctcctccagatccacagaattaaagtttcttcctggaaatttattaggtttctgcaaaaataattgcaatttttgtgattgctttcaatggcaaaaaccgcaattacttttgcagcaacttaatgcatctaacacctaatcaggagccatgctatccaaataagggcgattttaactggcaatttttggtgaaagtgtgttcaccaggttaatcaactatgaagttattttttcctttgcaatggataagtaactttttggaaaacctctgagactgtgtaaatatcctttgtcttcagtctttcacctaccagttttacaacccatgtacgatttttactgaagtcattgttactatgagtggcaaaatgatggccatgttcagtttcaagccaccaagatttggcaatcatgtcacaaaattcctgaatatttaatcattggttctagagagcaggagtaggctgactttggcatagagatttaaatatgtccatgtctacatctacttctgtctgtctgtctatctatctatcatctgtccatcaatcatctatttatctacttactgattatctagctatcatctctctatctatcccaatacaacttgctgtgataaaggaaagagcctactgttttagtgtttcatctagaaatcactagacacatatagctattgagcactgcacatgtggctagtgccactgatgaaaaattttaagttgtatttaagtttaattgaataaaatttgattttaaatagccacatgtcaatagtggctaccacattggacagcagagctctaaactttgagattatagtttggtttcacatcagtatcatcaggttcatggtaacagaatacaattattagatagttgaatttacccacaactgcatcacagaaatcttcactggtaaatcacagctctgttgacatttctcacactcctttcgtattggttttggtggtgagttacatggttggaacaggcactatatttatttctgtgttcccggtctctaaatgtcctaatccagtcctgatcaaacagaccagtgatgggccatcctgagcttctctcaggaaaaaaatcaagagaggggccaacttgcaatcacaagagcttataccattttaatgccattcatcagactgcaatcaatcaccactcatctagctttttgtccatcttcagttgctgtacatcctgagatagtcaattctgagacctatagcctgggtctattacctggtgcctctcaaagatataatccatacttctcaacctgggctatgcacacaaattaccacatcttgtgaaattcagacttgaatcagtagttcaatggtggggtttgagattttgcatttctgtttttgttgttgttgttgttgttgttttgttttgttttgagacagagttttcgctcttgttgcccaggctggagtgcaatggcatgatctcagctcaccacaacctcagcctcccagattcaagcgattattctgcctcagcctcccaagtagctgggattacaggcatgcgtcaccatgcctgggtaattttgtatttttagtagagaaggggtttctccatgttggttaggctggtcttgaactcctgacctcgggtgatccacccaccttggcctcccaaagtgatgggattacaggtgtgtgccaccatgcccagcctttgcatttctaataaggtcacagatgcttatgatccacggaccacactttgagtagcaagaggtggtctgtattccaatattggtctcttaagttccctcaaacatatctaaaggaaaggtcctttaattttccatacatctagccattaatgttgcaaattctctcaaagtttgtcaaggtatattgtagctaaaatgaattacatttttcttgggagagaagactaccccatattaatttacaataaagtacttttaggatcattcaaggagcacaccatgacactgagtatgttatgcagaaatgttctctctggaaattacccagctgtgaaggtggcagggatggcacgaggaggagcggatggtctacgttcttgaagacattgggggaaaactggattaaaatgatttgccttgttctggctctgtaagacacacatcagagtgaaaccacccccagtgagactctgaattgcttttctattttttcccctggggatttgaaggttccacttagatttcttttcatctaaactgtgatgccctacattgacctgatttacctaaaatgtcttttctctcctttcagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggtgagtggacagtacatggagaaggagggaggaggtgaagccttagcaaagatgcttcctcaccacttcccaggagaatttttataaaaagcataatcatgattgtttcattcacaatatgtaggaaggctctcaaaataaaaagaaggaagcatagggaatggttgctattggcagaagtataagatctttgtaaaacagtcctctccctggttcatctgctttctgttaccacaataatgctaagtaaaaaaacatccaaaaacctccctggcatttaacaatatgcatattgctcacacgtcttgatagtgagctctgctgatattggcaggacttgctctggtctggctgtgatctgatggagcctggccctgggtgcgctgtgcaggttgactcagctctgccccacatgtgtctcatgtttcagtcaggtaaccactggtgaagaagcaagctaggaaccagggtatctgacttctgagctaaactcttaaactctataatattgcctttcaaatataacactaagtactaggtgcctatcaaccacactgttttcagacctctgccaaaacttggattctttgtgctatgaagagacatggcttttgggctggtctttgtgtggcagtgaggtgagcacaaagggatgttcttcagagattacagtccagccctgaagcaacaactaggagactgtttcagcaagtgaggacagggctgtgtggggttctatccttttcataactttgcctggcactgaaatcacatgctctgataacatccaccagaactttcttttgtcatatttgggatagaaagggactagtttttcctcaaattattgatagagattttatataatatagtgtttctctccacattttatgtatataacaaaagccctgcttttgtgtatatatgcatatatatatatatacacacacacacacacacatatatataatacaaatcctgctttgtaactgtttttgtttgtatatataacaaaaagagttatgaaccagaagtttggccaataatccttgtcgcacagagaatttgctttttctatctgttttcactttcttggttacagacgtgtaacctcttttttgaatggtgacaatcactttgtcatattttatttgatgctagtggtcatagcctattagtcatgtttgcttccatgagaaagaaaaaccactacatggttatgctaaggatttcagtcattggggttagagccttcccgaatgtctcctgctttcataactcctccacacatcttagtgggccattgagcacatcaaagggcatgacagttattaaaatactttatgaatgctacaatcctttgccagtatgagttgttctctggaacttctaacagttcaacagtactacatggactgagttaaaagttaattcaaaaatctcaatttatccaaatctgtttctttcttttcaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggtaggaggcccctgggaagggagccctccctgaaccagcctggttcaagcatattctgcctctctacaggacagtctgggcttgtacaatcatttgcttgtctttttatgtttaaaaggttttttcaaatcatgaaattgatcattgtcacactttacaaaccacagactagataaaagaaaactatagccagtcacagtcccagcaacttaagatgaaggtcctcaattatgtccttatgggtcataagtgtccaaaatgtaaggactcttttaaaaacacatgatcacaatgctattattatgtcccacaaatgaatattttttcctgaatataatcaaatcttcaggaatcaaatttgaataaaaaacatgcgtctaatcttcaaagaatttataggttagtgcaacagatagacaaagaaagcagtgatgacactgctttccatcaatacagtagcatcatatgcctgtgtaaattatctgacttaaactattctatggaggtgtgggggagaaagaaggagagatggagattagaagaaggaggagaaggaggagagaaggaggggtaagacaaggtagggaggagaaggaggagaattagaaaaacaagagacgagaggagaaggaaagtgcaaaataacaattttgaagtagtgcaagacaatttcttctccttcctcatgaccaacataagggtgacttgaggcaggaatctacttttctgtcagtcattctcatcacttatgtgccttttgtagtgtgaacacatcaccatcctgactataatttgagtgtttagaaataaatatactttgcaacagtatttatctcctctcaacaagactgaaagctcctataatgtaaggagagtagaaaggatctgtaccttacaattctcatagcaaaatatgcatagcaggatttcagtgactagcccacaaaagtatcctgtgtactgctagtagaggggtgggccctaagtaagaaaccctaacatgtaactcttagaggtattatgtctttaacttttaaaatatctaccaatatggaaccaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacaggtcagtcaattttctgcattaataatgttttattaacaattattttaactgaatggtctatatatttaaaaaagaatacactcacttaatcttttaataatttgttctatgggccaaggaatctatttggacccatctatgatctttaagggtgcttcagttctggagttcaaaagctgtagcattaaaaacatcatgcaatgtcaatgtagactagcatgacatgattatctacagtctccttgaacttgagcaaaattaaattcagtttcaagtcaattggaaagatggggaagtattttgcacaatcatgaggtgcacttattatcttgttttgacttttgaatgatgctcttccttcccagaacttgtagaagttttctcatgacagtggctcccaaccactagctgtacattggaatcaccagggagctttaaaaattcatgatgcctggaacatctcagaaattctaaactaatttgcccagagtgtggctttaaaagctcccccattgcttctcatgtgaagccaaggtggaaaatgactaatttaaggtagttctattggatacgaaggactaccacagtccaaggccatccttactgacctcaccttccaggtgcctagctccaaccaactgggctccttttcaactcaattataactctgctaatcttctttcctttcttctcctcattctgttcttatctttcaagtcctaattcaattcccaagcccctccaaggtgtcttcttgacctagtccagggctcatttactcctctgctctgttattagttactggaggctattatcttataatttcataatttgccattaaatcattgagttttgttctctatattttctctttatctaagaatgtcttcccccctccattaacaatatcctctcattttattccatttaaaatatcccagtggtgccttgcaagtgacctcatctaactcaagcatttggtcatttggtaaatgtttaaggagtgatatgcagtcgattggtttgcatacaaatattaagttttttaatgtgaacatttagcaaatgacattcatgtatttgcatgtgtgtgtgcttgcacatgtgcacatgcatgtctgtctgcagggaaaatatattcatgccttttgaaaatttttaaataatgtgttatatttatagaaagatttggaaccttttctctgaagaagttaaagaacagatgtcattgattcatattaagcaagaccctataaatcttatttctaggtctcatgtatttattaagcaactccacaccttaagcaggctttctacatagaagaggaagaagatagagatggtttccatattattttcatattccacattatttgtggctttaggccagctatgtagctatcctgtatgtgtgctcagacaggagactcagccctgagagaaggcggtcctctggcacacctaggatggggaaggtactcccttggaagtcccaagctggcacttctggatctccatggcaattttcttgcccatcactccatggagatcagaatatcactctattgtgtcccctcaacactgaaggagtgtctcaataagaaaagttgagtcaaaacactgtaggaattgagaggttccccacttgcactacccttgtaaaccaagagaagatgttaaaaaataaaacgataatgcttcctgaaggtgtcttcccatctttacactagatgggttcaattgagaggaattactggactgtggaagttgaagactgtccacataattaaaatgtacaatagctactcaggattaccttgcaagtttcaacatacacaaaattaacttcataagatggtttaaaaagtttaccgttatacctaataatctggtttaaatttttaaaactcatccattttcgttaaaatttaaatcaaaaaagaacacgggttcccatgaatttgtctcaggtcaaacctcacacagaataggtgctccatgaatattttgttaaatgatagatgatgaatgttctcactatccaatcttcacacatcttatagagtaagtataacgaatccaagatttatagtgctgaaagtagtttttatatgtttacaaagcattattgtcagtaatttttttttactttgatgctatactttctacttttgctttatttaatgcttctcaatatgctcgtttaactgttgcagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaactgaatgactgagaaccaacaactaaatattttgatcattgtaatcactgttggtgtgggaactggagtgcagtggtgcaatcttggctcactgcgagctctgcctcccaggttcacgccattctcctgcctcaacctcctgagtagctgggattacaggtgcctgccaccacgcccggctaatttttctatttttagtacagacggagtttcactgtgttagccaggatgctctcgatctcctgaccttatgatccacctgcctgggcctcccaaagtgctgggattacaggcatgagccacggtgcccagcccaatttgattattaacataggtgagagttaacccactatgactttgcccattgtttagaaagaatattcatagtttaattatgacatttttgatgagacacagtggctcacacctgtaatcccagcactttgggaggccaaggcaggcagatcatctgaggccaggagttcaagaccagcctgaccaacatggtgaagccccctttctactaaaaatacaaaaattagctaggtatggtggcacacgcctgtaatctcagctacccaggaggctgaggcaggggaattgcttgaacctgggaggtggaggctgcagtgagccaagatcatgccactgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattggacaacaaggctgaaactactcatttcttttcttttcctatttcttcctttattttccctttctgaataatttagccctagagccattaggtgggtggcagccagatggtggccacacattaaggtagagaagagagtcatggtggttccaagtcagagaccaagtaggatgaggacaaactgggtgttcatgtggaaacagcctgcctgggtgtgggagtccaagcaagcagagaaggggttcatagagaggtgtggcctacaagagcagccagagcctaaatagagcatggagaacccatgtgaggtcaggagggcatccatgagtgggaagtgatgggtgaggtttggttacataaaggggatttatcaaagaagtaaatatattaaggatgatagaagccaggcttctcatctttgaagaacggagtcatggattcagaaagggagaaaactagcatgaatcctatgaaattagattggaatggatgtattcgtgtatattcatacccttctagatggatagatgggtagataggtgatagataacagatatatgatagatatatagatagatgaaatgtatacatgtgtttgtgtgtgtgtacaaaaaaaaccatatatttcctacttctcttcactgataggtctaggtaacaatgacatttcaatagcaatgagcacacttagcgcccaagtcttggcttatgaataccatattccatggaaaggaaccagagctctttagagaaatgcctgattccagggccagggttaagaaggttcaagacaagcctaggacacattttgtgccaggaagcaagaaaatgttcaaatgatttccaagtaatgtttggaaatgatatttgaaaaagaccctccaaatgataactccaaattattttcaaatgatatttgcaaaaacctaaagactccaccaaggaactattagaactgataaaatattcagtaaagttgcagttgcaggatacaaaatcaacatacaaaaattagtagcatttctatatgccaatagtgaacaatttgg

SEQ ID NO: 14433 - DNA, 103934 bp, Human
  misc_feature (1)...(103934): n = A,T,C or G
agtcactgagcctcagtttctacatctgtaaactggggatagtagcatggcccctacttaatgtgctcagcaaagccactgaaaggagacagaaatgtatctaaattccctggacttttatcctacctctcttggggattgtcaccaccttcccatgtttgtcctttttggtttgatgcttgctgtcacttctttccttaggtgcctctctgtacggctcttttatcccagggattccagagttacagcacatgcataccaccatccaagcatgtttatttgtctcctgcttcactaggctgtccccaaggaacatgtggctcccggcacacacctggcacaacactgcacatgacattcacccacttggccttgaatctgacaaggaatctggcatgatgttcacccactcaggccaggtgccgagcagccctggaggcttaggggccagagggatgggaaaaggtgtctttctggggtgagtatcagtttctgcaggagggctgaatgtgagaaagaataaagagagaaggaagcgaacaagcacagcttaaacatcgcctatttctattgagttttaagaacgctgtgattttgtttgtcatgcaatccattcatcaggccaggcagacacagaacttgggtgtgagtgacgataatgagctgatataattttcacaccctcatcactgagatctctcccatcaggaatgggtcagggagctcacaggtggcagcaactgctattacaggcctcatctctaccagctcctggggcctgccctcctcccattagaaaatcctccacttgtcaaaaaggaagccatttgctttgaactccaattccacccccaagaggctgggaccatcttactggagtccttgatgctgtgtgacctgcagtgaccactgccccatcattgctggctgaggtggttggggtccatctggctatctgggcagctgttctcttctctcctttctctcctgtttccagacatgcagtatttccagagagaaggggccactctttggcaaagaacctgtctaacttgctatctatggcaggacctttgaagggttcacaggaagcagcacaaattgatactattccaccaagccatcagctccatctcatccatgccctgtctctcctttaggggtccccttgccaacagaatcacagaggaccagcctgaaagtgcagagacagcagctgaggcacagccaagagctctggctgtattaatgacctaagaagtcaccagaaagtcagaagggatgacatgcagaggcccagcaatctcagctaagtcaactccaccagcctttctagttgcccactgtgtgtacagcaccctggtagggaccagagccatgacagggaataagactagactatgcccttgaggagctcacctctgttcagggaaacaggcgtggaaacacaatggtggtaaagaggaaagaggacaataggattgcatgaaggggatggaaagtgcccaggggaggaaatggttacatctgtgtgaggagtttggtgaggaaagactctaagagaaggctctgtctgtctgggtttggaaggatgtgtaggagtcttctagggggcacaggcacactccaggcataggtaaagatctgtaggtgtggcttgttgggatgaatttcaagtattttggaatgaggacagccatagagacaagggcaagagagaggcgatttaatagattttatgccaatggctccacttgagtttctgataagaacccagaacccttggactccccagtaacattgattgagttgtttatgatacctcatagaatatgaactcaaaggaggtcagtgagtggtgtgtgtgtgattctttgccaacttccaaggtggagaagcctcttccaactgcaggcagagcacaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctgtgagtaactgtccaggctcctcttctctgtttccttggacttggggtgctaatcaggcctctctttcccttatctgttttgaagatcaaaaaagatgttcaggccgggcgtggtggcttacacctgtaatcccagcactttgggaggctaaggcaagtggactgcctgaggtcaggagttcaagaccagcctggctaacatggtgaaactctgtctctactaaaaatacaaaaattagctgggcatggtggtgcacgcctgtattcccagctacttgggaggctgaggcaggagaattgcttgaacccggcaggcggaggttgcagtgagctgagatcatgccagtgcacttcagcctgggtgacagagtgaggctgtctcaaaaaaaaaaaaaaaaaaaaaaagatgttcaaggagcagtagcttaagtgttggatgctacaaacatatagaggttattgtagatcttatgcagctctataaaggaataaataagcatcttccccatccatctttagtggcaagaagggttttgggatagcattgattgaggatgatctacttgacaatagtttggacccaaggaggataaggaaggaaagtagtgacggatctcattccaaacttggctgtggaaacctggcttctccttactaaactagaatttggattttacattttcccctttatgttgcagtagaagaggatgaatcctctcactggtgggatcctgccatcctagagcaggtagagagaagagtcactccccactgtgggtagtggaggcttctcacatgtcacatttcacttctacctcaatttcactcttactaagatttgggaatcataatgacaggaaaatagaaaatataaacctcattttaattctttcacagaaaggttagaaattcagtgagttgtggcaacatattttccatcttctgaccttttaacactaattgatatggcttaaattcattctattttaaaccagatttttttggagatagtctatttccaacatgttccttctaggtgacaaatgagggctgttagttcagtatttgttacaataaatgtgtgtaaaataacctcacctttccagaatcatgtcaggaatatgaatctaatgcacaaatgtataactctatgacaagattgcatatatcttttaaaatataccttcccaacgttcattttaatacccctatttcaaacaaacctgcttagcaggttatgttaaacgctcagggcagaggagtaagcaagactgtgagccagtgatgacagcaaaagcatccaggtaggatcaaaatggagtaagaaaatattcctcatccctcagggtagaactccaaagagatattcatgggtcctggccccgtagtggaggtcactcaaaggacaaacatgtttgcatctcatctgcttgaagcctggacacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctcagtaacatcagactgggaaggtcttcagacatccagaaaccccagttcggggagttcatacatgacccatcaaagatgagttgcaagcaggcctgccttagggagcaccagccttaatgggttttcctacagagatagttgatgggcagatgcaataaactgactgctttgtgattgaccaccttgagaaaaattagcatgtctggctatgttagtcttttcttgcattgttataaagaaataccagagtctgggtatttataaagaaaagggatttaattgtctcatggttctgcaggctgtacagaaagcatagtgacttcttcctctagggaggtctcaggaaatttacaatcatggcagaaggtgaaggagaagcagacagatcttacatggctggagcagaagcaagagaggctggggagaaggtgccacacattcaaaccaccagatctcataaaaactcattgtcacgaggacaacacctaaggcgggatggtgtgaaacgatgagaaactgcccctaggatccaatcatctcctaccaggccccacctccagtattggggattgcatttcaacatgagattttggtaggggcacagattcagaccatatcactggcactgtgctaatcagatgaatatcaccagttggaaggctagattccacaagaggaggaatgacctggaaattggttctttagttgtgattcttctgcacactgtcattcagggaaatatgagtcaatcatccttcccaataggtcaaatcaaccagatcatctgatcacagagactgaggtgtagctgaaagctgctcacatttctatgaggtcaatggaagccttgagcacagttgtcaatctgtagaaataaggactctgtgactcctccaagacctctctgtgaatgacggtttaagaagaaccagatcctaaaacagggtcagagcttagagggaagggaaagcataaaagcctctgagcaaattctaaagacagggtcaccataggctctcagtgaccctctgtgactgagtggctgcagtgatgcaaaatctcatcatcactgcggaagacaaaaaaatgtcaccctttctacctaggatgagaatccccaaatttggggagaggccacttactaaatagacgtaaaggaacaaagtgacctggaagaattcctgcctgaacctctcaggatcattcacatttgagaacatttatcaaatattcattccaggactgggaccatgaagacttcagctgctttgagctaatcattgtaactttttggtgtctcatggtggaggcaggaaaggacctgatgaacaaatataatcattgccgtcagagttactgttattatttcttgccttaatgttacctcgttctcttgagcattccagttcctcagtcaatgactcatcaacccctatatctataaagtcacaatcgctgtgacttgatttctgtttcactttgtagatatggaacccattcacatggactttttaagaagcttggaattccagggcccacacctctgccttttttgggaaatattttgtcctaccataaggtgagtgtttttgagctcactcttttgcttcttatgattgccaagagcagcttagttccatcagtaaaaatgcttctcctcagggggaaggtctgaagttttacactttcagaaacagtgtgtaggcatcacccagaacatggcaatgtttacccaagggctctcttgctaactctcaggaacctcaggtttgcctcagttgaacagcccaaatctcaggtagatcagcaacctgatgctcagaacttgatgtgcaaactttgtgagcgccataaagaaggttttctttttgctctatgcaggttcccaggaaggtacagtcatacttagttagtattaaaagtaggaaaaggaccccctgattgtgacttgttatctgtgtacatgagagtcaaactttcctctctgtagcaagagctcttgagtagccttttttcccttccttctggacagctttgaaactcaatttattagggagcccaggtatttacctttgggtcatttgcacctgcttcaatcctctccgaaaaatgctaaattccctgagggtatctccatggctctaccccagctcttactccccatgacatcttttgcagctttgagagacagaacaaaggggttctgctttatttcttttccttcaaaggctgcaccttatgggtgagactgatcacagactggatataactgagatgagacagtggtggtcaatcaaactcagatatttaagcacaaaatgagtttgtggggttttttttttacacaaaggcggaatcacatgcaaaatcactagaaaggggatgatttgatgaaattattaaatatttaattttgctgaatagaatataatatgtgccacgtggaccgtgaactttggccgagcctttgtgcctaacctagtctgatgctctgcccagggtctgggccctggatggaaaattaggagcccatgtccacatggccagccgcagcagtcagctctttggcttacatcatctttcccacatacctgaggcttgtttctcagattctaattctctcaggtgagggctttgttgtctaattactatccaggaatttcatattttttccctgtgcaaaagcaataatttccccgccaccttttccaggtcaactctttagtagatgtacccccaagatgcacattcctgggacctttgtttgcacagttaaaatgtcacccctgaaatgtcgatacaggaaggtttgtttttaagtttcagtgaaaactctgagcaagtgttgtaatttgctgtgtccgatgtgtagaggggacattttctcagaacttccatgttaagctggaaaactggaaagtgagttcactttgtcattctgtcactcgttcattttctcactcaacaacatgcctcatacttacctaaatctgctagactaaaggagttccctggtgtctgtaactttccaattctgctagaactctagagcgagctcatgaaataaatgaaaaggatgacaaagagataaaacactgtgcattctcttctgatgctaattcactttcccttggcctcagtttccccatgtgcccctggaggtgatcattcagggattcatgagattttcaagacaacacatgaaaaagcaaaaagacatcagaaagacaaagaggtacttagtatttatacacaaggataagtcattcagtatccacaacacttggagagaattcaagagtgattttaaatttcccttttcaaatacctcctctgttttctcttatttcctttatgacgtctccaaataagcttcctctaactgccagcaagtctgatttcattggcttcgactgttttcatcccaattagaggcagggttaagtacattaaaaataataatcaaatattattttgtttctcctcccagggcttttgtatgtttgacatggaatgtcataaaaagtatggaaaagtgtgggggtgagtattctggaaacttccattggatagacttgtttctatgatgagtttaccccactgcacagaggacagtctcagcccaaagcctcttgggatgaagctcttgtcaacctaactacaaacagagagaagttctctgaaagaagaagatatttatttgggtgtagagtattgcaatgggaatctgcatgcctttataaactatgtgcaaattcagggaagtaaagcaagacaaagaggctccaaggaaaatatgaggaggatttcttatcagttttgaaataattatccttcgctacaaagatcagtaacaagggtgacgcctcaccaaggttggacaggcagttgctgggcaggtgtccttgcagaaatattttttttaatgttgggatggcctttgtgcaagcttgtagttttgcggagtcttttgtgatagttttgttatcaggcacacaagcatgagaatcctctcttcatagccttctttgatttatttgtcagggtttttacacacacacacacacacacacacacacacacaactagtgacatcattttggttctaacaacattcacactggttattgtaaaacttttcgaaggttgtcctaccaaggatcccatgtgtcaccaggtgtcaagttctacagtctgaactaggctgggagcattgtgattacttttctccagactttggtggcccagggactcacagcatcatgctctgtccagtgtctgcctattcccctcttctttttttttttccttaggtgcccttttattacatgtgttgtctcagacccttctaatatgtgctcataaatacatcatatcatctccttcccacatcaattcactttcaattaaaagccaaaactctttcatttagactttggatttaaagtgcttttgaatgaagggttgagagataatagagaaatagattggcaaaccatttatactctgctgttgttgttttttaattttatctgcaagtgtggaacttttcattctgttttgttattaaatttaagccaagactttttaatagaagggtatataagcatttctttgtctataccttcctgctgaatttgaagaaatgctgaatattcttaaccactggcgggctgatggactgtgattttattttattttttatttttagttttttaaattatactttaagttctgggttacatgcatagaatgtgtagttttgttacataggtatacacgtgccatggtggtttgctgcacccatcaacctgtcacctacattaggtatttctcctaatgctatctctcccctagccccccacccaacaacaggccccagtgtgtgatgtttccctccccgtgtccatgtgttctcattgttcaactcctacttaggagtgagaacatgtggtgttgagttttctgatcttgtgatagtttgctgagaatgatggtttccagcttcatccttgtccctgcaaaggacatgaactcattgtttttttatggctgcatagtattccatggggtatacgtggcacattttctttatccagtctgtcactgatggacatttgggttggttccaagtctttggtattgtgaatagttctgcaataaacatatgtgtgcatgtgtctttatcatagaatgatttatgctttgggtatatgcccagtaatgggattgctgggtcaaatggtatttctagttctagatccttgaggaatcaccacactgtcttccacaatggttgaactaatttacactcccaccaacagtgtaaaagtgttcctatttctccacatcctctccagcatctgttgtttcctgactttttaatgatcaccatactacctggcatgagatggtatctcattgtggttttgatttgcatttctctaatgaccagtgatgatgagcattttttcacatgtctgttggctgcatagatgtcttcttttgagaagtgtctgttcatatcctttgcctattttttgatggggttgtttgctttttttcttgtaaatttgtttaagttctttgtagattctggatgttagcccttcgtcagatggatagattgcaaaaattttctcccattctgtaggttgcctgtttgctctgatgatagtttcttttgctgtgtagaagctctttagtttaatcatatcccatttgtcaattttggcttttgttgccattgcttttggtgttatatttatgaagcctttgcccatgcctgtgtcctgaatggtattgcccaggttttcttctaggatttttatggtcctaggtcttacatttaagtctttaatccatcttgagttaatttttgtataaggtgtaaggaaggggtccagtttcaattttctgcatatggctaggcagtttcaccaacaccatttattaaataggaaatcttttccccattgcttttgtgtgtcaggtttgtcaaacatcagatggtagtagatgcatggtgttatttctgaggcctctgttctgttccattgatctatatttctgttttggtacctgtaccatgctgttttggttactgtagccttttagtataatttgaagtcaggtagcgtgatgcctccagttttgttctttttgcttaggattgtcttgtctatgtgggctcttttttggttccatatgaactttaaagtagttttttccaattctatgaggaaagtcagtggtagcttgatggaaatagcattgaatctataaattaccttgggcagtatggccattttcatgatatggagtcttcctacccatgagcatggaatgttcttccatttgtttgtgtcctcttttatttcattgagcagcggtttgtagttctccttgaagaggagaacttcacatcccttgtaagctggattcctagatattttattctctttgtagtaattgtgaatgggagttcactcatgatttggctctctgtttgtctattattggtgtgtaggaatgcttgtgatttttgtaaattgattttgtatcctgagactttcctgaagttgcttatcagcttaaggagttttggggctgagacgatggggttttctaaatatacaatcatgtcatctgcaaacagagacaatttgacttcctcttttcctaattgaatatccatttctttctcttgcctgattgccctattcagaacttccgacactatgttgaataggagtggtgagagaggacatccttgtcttgtgccggttttcaaagggaatgcttctagtttttgcccattcagtatgatattggctgtgggtttgtcataaatagctcttactattttgagatacgttccattgatacctagtttattcagagtttttagcatgaaaggctgttgaattttgtcaaaggccttttctgcatctattgaggtaattatgtggtttttgtcattggttctgtttatgtgatggattacatttattgatttggtattttgaacccagccttgcatcccagggatgatgctgacttgatcctggtggataagctttttgatgttttgctggatttgatttgccagtattttattgaggattttcgcatcgatattcattagggatattggactaaaattctctttttttgttgtgtctctgtcaggctttggtatcaggagatactggcctcataaaatgagttagggaggattccctccttttctattgttcagaaaaatttcagaaggaatgataacagctcctctttgtatctctggtagaattcagctgtgaatccatttggtcctggactttttttggttggtagcctattaataattgcctcaattcaaaacctattattggtctattcagagattcaacttcttcctggtttagtcttgggagggggcatgtgtccaggaatttatctatttcttctagattttctagtttatttgcatagaggtgtttatagtattctctgatggtaatttgcatttctgtgggatcagtggtgatatcctttttatcattatttattgcatctatttgattcttcttttttctttattagtcttgctagcagtctatctattttgttgacctttttcaaaaaaccagctcctggattcactgattttttgaagggtttgttgtgtctctatctccttctgttctgctctgatcttagttatttcttgtcttctgctagcttttgaatttgtttactcttgcttctctagttctgttaattgtgatgttactgtgtcaattttagatctttcctgctttctctagtgggcatttaatgctataaatttccctctacacactgctttaaatgtgtcccagagattctggtacattgtgcctttgttctcattggtttcatagaacatctttatttctgccttcacttccttatttacccagtagtcattcaggagcaagttgttcagtttccatgtagttgtgtgattttgagtcactttcttaatcatgagttgtaatttgatttcactgtggtctgagagacagtttgttgtgatttcttttcttttacatttgctgaggagtatattacttccaattatgtggtcaattttagaataagtgcgatgtggtgctgagaagaatgtatattctgttaatttggggtggagatttctgtagatgtctattaggtcctcttggtccagagctgagttcaagttctgaatatccttgttaattttctgtcttgttgatctgtctaatattgacagtggggtgttaaaatctcccattattattgtgtggaaatcttagtctctttgtaggtctctaagaacttgctttatgaatctgggtgctcctgtatttgggtgcatatatatttaggatatttagctcttcctgttgaattgatcccatcaccattatgtaatgcccatctttgtctcttttgatctttgttggtttaatattctttttaaaataaaatattttaaacatatgaaacattatggagaatggcatgggaaatatccacgtatgcaccacccagcttaacaaatgctctactgtcatttctaaccatggtctctttgaagagctcttttgtctttcaatgtctcttccttgtttggcccacattatccttcatcatatgaagacttgggtggctcctgtgtcagactcttgctgtgtgtcatacctaatgaactagaacctaagattactgtgtattgtacaactaagggattatgtaaagtcaggatcaaagtctggcttcctgggttgggctccagctgtagaataaggctgttgatgtttaatcaactctgtttttttcacacagcttttatgatggtcaacagcctgtgctggctatcacagatcctgacatgatcaaaacagtgctagtgaaagaatgttattctgtcttcacaaaccggagggtaagcattcatgtgttgaaattaaaatactgattgattaaatttatattttgaaattcttatatattcatagacagttgcctaaaaaatgtccaggaaggttccacgtccacttcatcctgtcccccccgaatggtaacatcttgcaatcttgcataactataaatacagtatattcatgttactatatagtacaggaaattgacattgatacagttcacagagcttattcagatttcaccagctttatgtgccctcatttctgttctatgcaaatttatcacaatcatagatttgtgcaatgaccagcatgatcaaaacgcagaacccatttgtgttctatacaaatttatcacatcattagtagatttgtgcaatgaccagcatgatcaagatgcagatccactctgtctccatgtggctccctcctgctatcctacagtcacaagtctttttctctgacagggtccatatcagagcaaactattttttattttgaggtgatcaatgtattaatatttccttttctggattgtacttttggtgccatgtttgaaagttctttgcctagccctccttcctatattgctgtttttttctaaaagtcataaagtttaatgctttactaaatgtagctctattatcaattttgtgttattttttgtataaggtatgagatttagatcaaggttcattttttttgtggcttatggctgtccaattcctccaacgccatttttggaaagatgggtatattgttaaaaatcaactgggcatacttctttgcatctctcacgtactactgtgtcccattgatcactgtgtttattattccaccaataccacactgtgttgaccctagtagctgtacactaactcttaacctcgtgtagagtgattcttcccacttttattgacttattttttcagatttgttttaactcttcctggtcctctgcttttccataaaaattcagaatgagtttctcagtgtctacaaataaacgtgctgttattttgacaagaattgaattaaatatatagaccagtttatggaaaatgtgtatctttactgtttgatctttcaattcatgaacatagtatgcctctccatttccttagattttctttgattgcttttaacatcttgtagttttcagcatagagatcctgtacatgttttgttagatttacagctaaattatttcatttttgttggaatgactgtaaatgatattatgtttttcttgtattttcagatattgattgttgttacatagaaatgtgctttgattttgtgtgttgatctggtatcctagaaccttgcagaactgacatagtagttctagaagtctctttgtatatgccttgagattttacacattgtcagttatgtcacttgaaaatagagacaattcttttatttcctttccaatctgtatgccttttatttcttttcttttgtctattgcactaggacttcccagtataatgttgagtaaatgtggtgaatttttgaattgttcctaatcttaggagggaagccttcagttctttcatcattaagcatcatttagatgaagtgggctgtttttttgtagattctctttatcaaattgaggaattttctctccctagtttgctgagtttttatcataaatgaatgctggaagtactcattataaaaaaaatggctatggaagatgaaagaaagtttcaagcatgttggcttgataggccagttccaagttggcaaaaataattatctcttttttctttctatccatgaaataaaaaattaagagacaagaatgtttatggaattgcattatttcttcaaaatatgttcctagttttaaaggtattacctactattttttttaaaaccatcacattgaggcacttctttttcacgttgcccatgctgcaggagaacataaagacagcttgtctgaggcaacatacaatccaccaaagtcacctgcttgtctgtctccactccgtctctacactgcagaagtgctaggtcttgattctgtttattgtactggaagaacacattctctaccacgtggataatttgcatgtaaaagaagactgggatatagaggctggagacgacatcagggtctcctgaacactgccgccacccccccgccccgccccacacaaatacatcccaggacactgggcatctgggataaatctctattgagcatctagcatagggcccatcacccagtagacagtcactaaatagttgttgaataagtgttcctgtttaacacattttctacaaccatggagacctccacaactgatgtaggacaaaatgtttctgctttgaactctagccttttggtccagtgggatttatgaaaagtgccatctctatagctgaggatgaagaatggaagagattacgatcattgctgtctccaaccttcaccagtggaaaactcaaggaggtatgaaaataacatgagttttaataagaaacttaaagaatgaatctggtggggacaggtataaaataagatcacagtccctttccaaggggtagtccactgaatttgagctgcctaaaaatggtcttttatctttatgtacagaaaacacatcacaaaattcattataaaatgtcacttactgctccatgctggggaaagccatgtccttctgggactagagtctgcacatttaactatgggtggtgttgtgttttgtgcttagatggtccctatcattgcccagtatggagatgtgttggtgagaaatctgaggcgggaagcagagacaggcaagcctgtcaccttgaaagagtaagtagaagcgcagccatggggttctgagctgtcatgaacccctccagctgcctgccatggagctgatattcctgctgttgggttattccagtgaccagacaaaaggagggctgtggtaatgcaacttcaatgggtctcccaagatggggcagctccgatgaggaggtggggcagctggaggaaaaggatcttctcccctgtgcacaggggccagggtttacatatccattaaattgtcaccttggatattctagaagactaaatatatcctttagggggaaaaagtgtgattgtaccaaagttttaagcatggagtgtatgggatggtggaaggggaaggcacttggtatctgttggttggcagtgagtaggttgggagagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgctgtcagggcaacctcagctcaccacagctggggatagtggaattttccaaagcttgagcagggagtatagagaataaggatgatatttctaggagctcagaacagggtactgttgctttgtaaagtgctgaagaggaatcggctctgggcatagagtctgcagtcaggcaatatcacctgtcttgagccccttaggaagagttaattattctactcttgttctgctgaagcacagtgcttacccatcttgtatcatccacaatcaatacatgctactgtagttgtctgatagtgggtctctgtcttcctatgatgggctccttgatctcagaggtaggtctaattcagttcagtgtctccatcacacccagcgtagggccagctgcatcactggcacctgataacaccttctgatggagtgtgatagaaggtgatctagtagatctgaaagtctgtggctgtttgtctgtcttgactggacatgtgggtttcctgttgcatgcatagaggaaggatggtaaaaaggtgctgattttaattttccacatctttctccactcagcgtctttggggcctacagcatggatgtgatcactagcacatcatttggagtgaacatcgactctctcaacaatccacaagacccctttgtggaaaacaccaagaagcttttaagatttgattttttggatccattctttctctcaataagtatgtggactactatttccttttatttatctttctctcttaaaaataactgctttattgagatataaatcaccatgtaattcatccacttaaaatatacagttcagtgatttgtagtacatttgaagatatgtgtgaccatcatcattttaaactttaaaactttttttgtcaatctagagacctcatacatttttagctatcagccccctgtcacaaaccctgtcatcatatgcaaccactaatcaactttctgcttctatggatttgcctattctggacacttcatagaaatgatattaattcatcagggttttttattctctagttcatgaatttgtactttagtctgtatcattttctttcttctgctggcttcaggcttagtttgcccttcttcgtttactatgttgtggcatgaacatagattactgatttgtgatttttttgttcctctaaatttagacattacagctgtaactttccctctgagcacttcctttgctaaatcccatgagattgtggcctatcacatcttagtttttgttcacctcaaaacagtttctatttgcccttttggtttctactttgactcattggttacttaaatgtttattatttaacttccacatatgtgtgagtttctcaattttctttcccttattgattttatctttattccatgataggtgacagagatatgctgtgttatttctatcttgactacctactatttcttgaacagcaagattaattttgagcttcagattatgatttgggttattctaggagactgtagtccaatagataaaggcaaagagattagggcattgaattttgttccttttatccttcaaaagatgcacaaggggctgctgatctcactgctgtagcggtgctccttatgcatagacctgcccttgctcagccactggcctgaaagaggggcaaaagtcatagaaggaatggcttccagttgagaaccttgatgtcttttactcttctggttggtagagaaaactagaattgctccaggtaaattttgcacattcacaatgaatttctttttctgtttttgttttgtttttcctacagcagtctttccattcctcatcccaattcttgaagtattaaatatctgtgtgtttccaagagaagttacaaattttttaagaaaatctgtaaaaaggatgaaagaaagtcgcctcgaagatacacaaaaggtaaaatgtggtggtagttataggaggatgtttagtttttcataattttttagataatatacatatgatcagtgcagttacctgtatgtttttaaagaatgcttttaacatgaagactgctcatgtttagagcaagagaattcatttggtagaaatgcagaaagtggggtttggggaaggagatatgagaatgagtcagagacagcacatgaaatttgatatcagacacaacaattagtatgccacggcataaattttattgagataaaactttaccactttacttcccttcaataaattgtcagaggataaacattactgtttggaaatatattttactgatattatgctttccccagatcataaattggtaaagactcatttcaagtacaaacctgttattttacacattctcaaatgaaagtccctatcaggccacctgctgaagtgtagcgtgtgttaaatttgagccatctcacatgatagccagatttgtttcaggaaaacatcctgctttccaaggatttagaagggtatgtttttcactggtgattcaggcaacatgcatcagatttctggtcttcaaggagccatattctcagaagggagatcaaggaccacgcttgtgatttacttctgacttcaggagccactttctgtcagtgaaatttctctttttgcttctagcaccgagtggatttccttcagctgatgattgactctcagaattcaaaagaaactgagtcccacaaaggtaaccagagtgtttctgagggctacttgtggggcactcagagggaaggccttgttctgaaaatgtgcaggaagtattccaggatgatgagaatttctgccacatagcagaacgacacatgtttgaatgttataagtggtagttggaggcactttctagaggcatgcaggcatagatagccatgttctaagagtaaagggcaaccctaagcaaacctggcatgctagaaagtcagtctgcggtctgtggatcacctacatcagatcaaatgccaattctcagcctccttcagatccactgaataaaaatttctgcctagaaatttattaggttgctgcaaaattaattgtgggtttttccattacttttaattgcaaaaaaatgcaattaaaagtaatggcaaaaaccacaataacttttgcagctacctaatacatctaacatccaatcaggagccacgctgttccaaaaggggtgattttaactggcagtacttgttgaaagtgtgttcaccaggttaatctactgcaaagttattttccactttggaatggattagtaacttgtggggaaaacctctgagaccgtgtaaatatcctctttgtcttcaatgtttcacctacgagttttacaacccatgtatgttttttactgaagtcactattactatgacagtggcaaaatgatgaccatggtcaattacaagccaccaagacttggcaaccatctcacaaaattcctgaatatttaactattggttctagagagcaggactgggcttactccagcatactgctttaaatatatccatgtctacatccacttttgtctgtatgtctatgtatctatctatgtatctatctagctatgtatctatctatctatctatcatctatctatctatcatctatccatctatcatctatcatttatccatctatcatctatctacttatatattatctatctatcatctaactattcatctatctatcccaatataacttgctgtgataaaggaaatagtctattgttttactgtttcatatagaaatcactagacacatatggctattgagcactggatatgtggctagtgccattgaagatcaattttaaatggtatttcagtttaatttaataaaatttgattttaaatagccactagtgggtagtggctaccatattggacagcagagctctaaactttgagattatagttcaatttcacatcagtatcatcaggttcatgataactgaatactatgattaggtagttgaatttacttataactgcatcacagaagtcttcactggtaaatcacagctctgtcgacctttctcacactcctttcatattggttttggttgtgaattacatggttggagcaggcattatatttatttctatgttccaggtctctaaaggtcctaatccagtcctgatcaaacagaccagtgatggaccatcctgagcttctctcaggagaaaaatcaagaggggcccaacttgtaatcataggagcttatgctattttaatgccatccatcagactacaatcaattaccactcatctagctttttgtccatctctcattcttgtacatcctgagatagtcaattctgagaactgtagcctagatctatcacctgatgcctctcaaagatataatccgtgcttctcaagctaggctatgcacacaaatcactgcatcttgtgaaagttcagattttgaatcagtagttcaagggtggggtttgagattttgcatttctaatgagctctcagatgcttctgacccatggaccacactttgaataccaagaagtggtctgtagaccaatattggtcccttaagttccctcaaacatatcttcgggaaacgtcctttgattttccctacatttaaccattagtgttgcaaattctctcaaagtttgtcaagatatattgtagctaaaataaattacatttttcttgggggagagtactacctcatattaacttacaataaagtacttttaggatcattcaaggaacacacccataacactgagtatgttatgcggaaatgctctctctggaaattacacagctgtgcaggtggcgggggtggcatgaggaggagtggatggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggtgagtggatggtacatggagaaggagggaggaggtgaaaccttagcaaaaatgcctcctcaccacttcccaggagaatttttataaaaagcataatcactgattctttcactgactctatgtaggaaggctctgaaaagaaaaagaaagaaacatagcaaatggttgctactggcagaagcgtaagatctttgtaaaacgtgctggctctggttcatctgctttctattactacaataatgctaagtaaaaaacctccaaaaacctcagtggcatctaacaataagcatttgttgctcacactcatttcacattggttttggttgtgaattacatgtttgcagcaggcaccatagtggtgtgtgatgtccccttagctgtatccacatatggacacaggaatttgctctttttatctctttttattttcttggttacagacatgtgacttttttttttgaaaggtaacaatcactttctcatatgttatttgatgctagtggtcatagcctattagtcacatttgtttcaatgagaaagaaaaaccagtacacggttatgctaaggatttcagtccctggggtgagagccgtctcgaatgtctccccacttcataactcctccacacatcatagttggatagtgagctctgctgatattggcaggacttgctctggtctggctgtagtctgacggagcctggccctgggtgtgctgtgcaggctgactcagctctccccacacctatctcatgttccagtcaggcagtaactggtgaagaagccaagctaggaaccaggatatctggctcctgagctaaagtcttaaaacactatcatattgccttccaaatataacaccaaatactaggtgcatatcacccacactgttttcagacctctgccaaaattgggattctttgtggtatgaagagacacggctttggggctggcccggctgtggcagtgaggtgaacacaaagggatgttcttcagagattacagtccagccctgaagcaacaactaggagactgtttcagcaagtgaggacagggctgtgtggggttctatcctctttataacttccactagcactgaaatcgtgttctctggttacatccaaccagaaccttctttgtcatttttgggatagaaagggactagtttatcctcaaattatttatggagattttatataatatagtgtttctctccacattttctgtatataacaaaagtcctccttttagtgtgtgtatacacatatatatacacatatatatgtgtgtgtgtatgtgtgtgtgtatatatatatacacatatatacacggttatgctaaggatttcagtccctggggtgagagccttcccgaatgcttcccaccttcataactcctccacacatctcagtgggccactgagcacagcaatgggcatgacagttattaaaacactttataaatgcttcgatcctttaccagtatgagttagtctctggagctcctaatacttcattagtactgcatggactgagttaaaagttaattcaaaatctcaatttatccaaatctgtttcgttctttccaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaaggtacaaggcccctgggaagggagccctccctgaaccagcctggttcaagcatattctgcctctcttaatctacaggacagtcatgtggttgtataattatttgcttgtatttttatatttagagatttttttaatcatcaaattgattattgtcacactttacaaaccatagactagaaaaaagaaaactacagtcatccacaattccaacaacttacgatgaaggtcatcagttatgtccttatgggtcatcagtgtccaaaatgtaaggactcttttaaaaacacatgatcacaatgctattattatgtcccccaaatgaatatttttttcataaatataatcaaatatttaggaataacattttaataaaaaacatgcatctaatcttcaaagaattttatagcttactggaacagatagacaaagaaagcagtgatgatactgcattacatcggtacagtagcatcatatgcctgtgtaaattatctgacttcaactattctatggaggtgtgggggagaaagagggagagatggagagaagaagaaggaggagaaggagggagaagacaaggtaaggaggagaaggaggagaattagaaaaacaagagaggagatgagaaggaaagtgcaaaataacaattttgaaatagtacaagacaatttccccttctccttcctcatgaccaatgtaagtgtgacttgaggcaggaacctacttttccatcagtcagtcccatcacttatgtgccttttatagtgtggacacatcaccaccctgaatataatttcagtgtttagaaataagtattctttgcaacactatttatctcatctcaacaagactgaaagctcctatagtgtcaggagagtagaaaggatctgtagcttacaattctcatagcaaaataagcatagcaggatttcaatgaccagcccacaaaagtatcctgtgtactactagttgaggggtggcccctaagtaagaaaccctaacatgtaactcttaggggtattatgtcattaactttttaaaaatctaccaacgtggaaccagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacaggttagtcaattttctataaaaataatgttgtattaataattcttttaactgagtggtctgtattttttaaaaagaatatgcttgtttaatcttttactaatttgttctctgggccaaagaatcaattaggcccatctgtgatctttaagggtgcttcagttctggagttcaaaagctgtagcatcaaaaacatcatgtaaagcccatgtagattagcatggcataattatctgcagtctccttgaacttgagcaaagtttacattcagtttcaagtcgattggaaagatggggaagtattttgcacagtcatgaagtgtaatgattaccttgttgtgacttttgaatgctgctcttcccaaccagaacttggagaagctttctcatgagagtggctcccaaccactagctgtacattggaatcaccagggagctttaaaaattcatgatgtctgggatatcacagaaattctaaactaatttgcccagagtgtggctttaaaagcttccccattgcttctcatgtgaagccaaggttgagaatgactaatttaaggcatttctggtggatataaaggactaccacagtccaaggccatcctgactgacctcaccttccaggtgcctagctccatccagctgggctccttttcaacccaattataactctattaatgttgttcccagccaggcatggtggctcatgcctgtaatcccagcactttgggaggccgaagcaggcggatcatgaggtcaggagatcgagaccatcctggctaacacggtgaaaccccgtctctactaaaaatacaaaaaattaccctggagaggtggcaggcacctgtagtcccagctactctggaggctgaggcaggagaatggcatgaaccccagggagcggagcctgcagtgagccgagattgggccactgcactccagcctgggtgacagcgagactctgtctcaaaaaaaaaaaaatgttgttccctttctcctcattttgttcttatctttcaagtcctagttcaatccccaagcccctccaaagtgtcttctcctcctagtccagggcccatttacttctctgctctgttattggatactggaggctattatcataaatttgacaatttgccattaaatcattgagttttattctctatattttctttgtatctaaaatgtcttcccccctccattaacaatatcctctcattttattcctttttaaaatatcccagtggtgccttgcaagggactgtatctaatgcaagcatttggtaaatgtttaaggagtgatgtgcagttgatggcttgcatacatatattaagctatttaatgtgaacctttaaacaaatgccattcgtgcatatgcatgtgtgtgtgtgtgtgtgcacatgtgggcatgcatgtctgtctgcagtgaaaatatattcagggtttttgaaaatttttaaataataaggtattatatttatagaaagatttgaaatattttctctgaagaagttaaagaacagacgtcattgattcatattaaacaataccctataaatcttatttctaggtctcatgtatttattattcaattccaccccttaagtaggctttctatataggagaggaagaagacagaaatagtttccatattatttccatattccatattatttgtggctttaggccagcagtgtagctgtattatatgtgcccagacaggggactcagccctgaataaaagtggtcctctggcacacctgggatggggaaggtactccttggtaagctcccaacctggcacttcttgatctccctggcaattttcttgcccattactccatggagatcagaatatcactctgttgtgtcccctcaacacggaaggagtgtctcaataagaatggggctaaaagttgagtccaaacactgtaggaattgagaggttccccacttgcactacccttggaagccaagagaagatgttaaaaaataaaatggtaatgcttcctgaaggtgtcttcccatctttacactggatgggttcaattgggaggaattactggactctggaagttgaagactgtccatataattaaaatgtacaataactacccaggtttaccttgcaagtttcaacatacacaaaattaactttatatgactcttcaaaaacagtttgccatcatacctaataatctggtttaaattttaaaaactcatccattttacttaaaatttaaatcaaaaaagaacacaggtttccatgaatttgtctcaggcctggcacagaatagtactccataaatattttgttaaatgatagatgatgaatgctctcactgtccaatcttcacacatcttatagactaagtataaagaatccaagatttatagtgctgaaagtagtttttatatgtttacaaagcattattgtcattactgcattttttttgcccattactccatagagatcagaatatcactctgttgtgtcccctcaacactgaaggagtgtctcactcactttgatgctatactttctacttttgtttatttaatgcttctcaatatgcttgtttaactgttgcagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcctaaaagcactcattccttttcttttccaaattcttcctttattttcccttcctgaataatttagtcctaaagccattaggtgggtggcagccagatggtggccacacattaaggtagagaagagagagtcatggtggctccaagtcagagaccaaggaggttcatgtggagagacatcctggcctgggtgtgggagtccaagcaagcagagaaggggtcgacgcagaggggtggcttgcaagagcagccagagcctaaatagggtatggagaacccacatgaggcgaggagggcatccatgagtgggaggggttgggtgaggtttggctacataaaggggattgatcaaataagtaaatgtattaaggatgatagaagccaggcttctcacctttgcagaagggagtcatggattcagaaagggagaaaactagcatgaatcctatgaaattagattggaatggatgtaaccgtgtatattcatacccttgtagatagatagatgggtagatagatgatagataggtaacagatagatgacagataatgagatagatagatgtaaatgtatgtctgtatttgtgtgtgtgtacaaaaaacatatattccctacttctctccactgatagggctaggtaacaatgacatttcaatagcaatgaacacacttagtgccccgatcttggcttatgaataccattttccactgaagggaaccagagctctttagagaaatggctgatgccagggcaagaattaagaatgttcaagataagtttaggacacattttgtgccaggaagcaagaaaattttcaaataatttccaagtaatctttggaaatgatacttgaaaatgacttccaaatgacatttccaaatgacttgcaaacgatttccaaatgatatttggaaaaacctaaagactccatcaaagaactattggaactgataaacacattcagtaaagttgcaggatacaaaatcagcatacaaaaatcagtagcatttctatatgccaatagtgaacaatctggcaaaaataaaaaagtaatcccatttacaatagccacaaataaaactaaatacctagaaattaacttaatcaaagaagagaaaggtctctacaatgaatactgtaaaacattgatgaaaggaattgaagacacaaaaaaggatatttcatgtttatatattgtgagaatcaacattgttaaaaatgtccacactactcaaagcaatgtacagattcaatgcaatccctcaaaataccaatgacattcttcaaataaatagaaaaaaatcccataatttgtatggaaccacaaaagacccataatagccaaagctatcttcagcaaaaagaacaaaactggaggaatcatgttacctgacttcaaattatactacagaggtacagtaaccaaaacagcatggttcttgtataaaaacagacacatagaccaatgaaatagaaaagagaacccagaaacaaatgcaaacacctacagtgaactcatttttgacactgctaccaagaacataccctggggaacagaacatctcttcaataaatggtgctgggaaagctggatatcaatatgcagaagaatgaaactagacacctatatctcaccagacacaaaaatcaaatcaaggtggattaaaggctgaaatctggctgagcagggtgactcatgactgtaatctcagtactttgcagaactttgagaggtcaaggtgggcagatcacttgaggtcaggagttcgagaccagcctggccaacatagtgaaaccccatctctaccaaaaaatacacaagttagctgggcatggtggtgcattcctgtagtcccagctagtccagaagctaaggtgggagaatcatttggacctgggaggtggaggctgcagtgggccgagatcattccaatgcacctcatcctgggcaacagagtgagacagactgaagtctaagacctcaagctatgaagctgctacaagaaaacattgtggaaactcttcaggacattggtctgggcaaaaatttctgaagtaataccccacaagcacaggcaaccaaagcaaaaatggacaaatggaatcacatcaagttaaaaagcttccgtgccgcaaaaaaagtaatcaacaaagtgaagacacaaaccacagaatgggagaaaatactttcaaactaacattctgacaacagattaatagccagaatatataaagagctcaaacaactctgtaggaaacaatctaataatccaatcaaaaaatgggcaaaagatttgaatagatatttctctctctcttttttttaattttgagacggagtctctctctgtcgcccaggctggagtgcagtggcactatctcggctcactgtaagctcctcctcctgggttcatgtcattctcctgcctcagcctcccgagtagctgggactacaggtgcccgccaccatgcctggctaatttttttgtatttttagtagagacggggtttcactgtgttagccaggatggtctcgatctcctgacctcgtgatccacccgccttggcctcccaaagtgctaggattacaggcgtgagccaccgcgcccggcctgaatagacatttctcaaaagaagacagacaaatgccacataggcatatgataaggtgctcaacatcattgatcattagagaaatgaaataaaaaactatagtgagatagcatctcaccccagctaaaatggcttttatccaaaagacaggcaataataaatgccagcaagaatgtggagaaaaggaaacccttgtacactgttggtgtaaattagtataaccactatagagaacagtttggaggttcctcaaaaaattaaaagaaagctaccataagatccagaaatcacagtgcttcggtatatacctgaaagaacggatatccgtatactgaagagatatcttcacgctcatgttcacaatagccactactcacaaatgctaagatgtggaagcaacctaagtgtccatcaacagatgaatggataaagaaagtgctccacttatacacaatggagtacaattcagatacgaaaaaagcatgagatcttgttatctgtaataacatggatggaactggaggtcatcatgttaagtgaaataagccaggcacagaaagacagacattgcatgttctcacttatttgcaggatctacaaatcaaaacaattgagctaatgtctgggtcttagtcaattttgtaccctaagtactgtgagcacagcttttaaaatacatgatgaatgctttaatacaggaatgaatagataagaggcacagggtgcctctgggtgttcttctgatacatagtatcttccttgacacattcagtacaactctcagcaggtaagtctcttcatgttatgttaccttctgaggaattaggtggcagaacatgccttctactattttcctttgcagaacaagaccagttgcattagttgggacacagtgctggctacatttgagtcccaagcaacgattagtctattgctgagagtaattagtctatttctacagacttagaggggatgacacacaggggcccagcaatctcacccaagtcaactctgccaacctttctggtcacccaccatgtgtacagtaccttgctagggtccagggtcatgaaagtaagtaataccagactgtgcccttgaggagctcacctctgctaagggaaacgggcacagaaacccacaatggtgctagagaggaaagaggacaataggactttgtgaggggataggaggcacccagaggaagcaatggttacatctgtgtgaggaggttggtaaggtaagactttaacagaaggggtctgtctgtctgggcttggaaggatgtgtaggagtcatcgagggggcacaggtacactccaggcagagggaattgcatgggtaaagatctgtaggtatggcttgtggggatggatttcaagtattctggaataaggacagccatggaaacaaggacaggtgagaggagatttaacagatttcatgccaacatggcacatgtatacatatgtaacaaacctgcacattttgcacatgtaccctaaaacttaaagtataataataataaaattaaaaaaaaatagagttcataccaatggccccacttcagtttctgataagaactcagattccttggactccctgataacactgattaagttgtttatgattcctcatagaacatgaactcaaaggaggtcatcaaaggggtgtgtgtgattctttgctactggctgcagctgcagccccgcctccttctccagcacataaacatttcagcagcttgtcctaagactgctgtgcagggcagggaagctccaggcagacagcccagcaaacagcagcacacagctgaaagtaagactcagagaagacagttgaggaaggaaagtggcaacggacctcatcccaaatttggcggtggaaacctggcttctccttgctgtcagcctggtgctccactatctgtcagtaactgtccagattcctctcctctgttaacttggacttggggtgctctcaggcccctgctcccttatctgttttgaagatcaaaagagatgttcaaggaggagtagattaattgttggatgctacaaacacataaaggttattattgatcttatgcagatttatgaataaataaataagcatttgtcccagctaccttctcattttggtaactaggagggtttagggacagcatttggtagtgggaatgatctgattaggttagatttgacctatactaatcaacaaaaacccagcaaaggcagattacaaactgctgaacacgatggggagtgtgatcctcatccccttcccaggttctcaggattctggggacaggagggagcagcttgggtttttgtctcattaccttcattttctgggttctctgtctgctggaagagatgtgtagaagtttgtcccctgtggacctggtggttcctgctcccccaacttccaccccaggatatcatttacataacgcaccggggaacaccaagacttcacgggaagctgtcccccggctcttccctctttcctgtgccatgtcccaaaacatcccctcccacctatgactcactcctccaccctgtcatacacagaactatttaccttgcaatgattaatctccagagcaaaggagacttggaggaagttttgaagatttattctttgctttaatctttttcctcccgtctctgggaggctagcattaatatagagctttgtttctcacctaatgggaatctgctagcagcctgaaaaggcaggagctgtgaaagccaatttggattttacacattttttcccctttgtgttacagtaaaggaggatgaaccctctcactggtgggattcctggcatcctagagcaggtggagagaagagttacttcccactgtgggtagtggaggctccacctgttccattaacttctacctcaatttgacttttattaagagcagggaaccacaatgacatgaaaatagacactataaaactaattttaattctttcacagaaagcttaggaattcagtgaatagtggcaacatagtttccattttctaacattttaaaataaattgatatggtttaaattcattcatttttaaaccagaattttttggagatagactatttccagcatgttccttctggatgataaaagagggctgttagttcagtatttgtgacaataaatgtgtgtaaaataacatcacctttccagaataatatcaggaatatgagtctaatacatgaatgtatatctctaagacaagactgcatatgtctttttaaatatacatgcctgacagtttattgtaatacctcctttttgaatatacctgcttagcaggctaccttaaactctcaggcaggggagtaagcaatactgtgagctagtgatgatagcaaaggcatccagataggatctgcatgaagtgagaaaatattcctcagctctcagggtagaactccaaagagatattcatgggtcctggccccacagtggaggtcactcaaagggcaaacagattggcatctcatctgcttcaagcctggatacagggacatcaaatgtgtcactctgtgtgtggtctgccatgttgtggggaggccactacagactcgggcagctgggcagacaataccttagccttagacgatgctagtgtagcccaggaatcagaaactatagtgtagaccgtgccctccttaggccaacacaattacatgcaatagatgacgggcttttctgttagcctcttcattggaactgaaagtggcattactctaccaaacagaggagagctggaaagaaactaaacagtttgcccagcacagcctctgccttgacatggaaccatgtgagtctagacactcacctagatctttccctgggggccaatgctgctgacacattaactcattagtttgtcctggcctgagagatcatgtaacatgtagaaggtttagaagcagagattagtgtcattaatttgccatggctgtgacaacaaaggaagaaactggggtgggaaaccccaaggccaccctggttttggtagatggtgcacacacttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacctgttatagaagagaaaacaaggtcttaattcaactatctggaacattttatggttacttatgtaaaatactgcatcttttgctatcaacaggaaggtacatggacattagaaggcccctgcctttcagctgaaagcacatatgaggcatatggatccatttatatacaccatacttttcagctgcattttcctaatttgcctctctggggccaaccttgtgggactagcagattcacggttgaattgatggctggtgatgtctgccatcagcctttcttcttcctctagtcctccgctcctcagtaacatcagactgggaaggtcttcagacatccagaacccccagttgggggagtccatacatgacccatcaaagatgagttgcaagcaggcctgccataaagagcagcagccttaatgggttttcctacagagatagtcaatgtacagaggcaataaactgactgctttgtgattgatcaccttgaaaaaatgagcatgtctggatatattagtcatttcttgcattgctgtaaagaaatacctgaggctgggtaatttataaagaaaagagatttaattggctcatagttctgcaggctctacaggaagcatagcgacttctgcctctagggaggcctcaggaaatttacaatcatggcagaaggtgaaggaggagcaggcggatcttacatggctgtagtagaagcaagagagggtggggaggaggagccacacacttataaaccaccagatctcataaaaactcattgtcacgaggacaacagcgaaggcaggatggtgtgaaaccatgagaaactgcccctaggatccaatcacctcctatcaggccccacctccagcatttggggttacatttcaacatgagatttgggtaggggcacagattcagaccatatcactggcactgtgcttatcagatgaatatcaccagttggaaggctagattccacaagaggaggaatgtcctggaaattggtttcttaagttgtgattcttctgcacactgtcattcagggcaatatgagtcaatcattctcccccatagctgaaatcaaccagatcatctgaccacagagactgaggtgtagctgaaaggtgctcgcatttctacgaggccagtagaagcctggagcacagttgtcaatctgtagaaataaggactctgactcctccaagacctctctgtgaatgacagtttaagaagggccagatcctaaaacagggtcagagcttagcagaaagggaaagcataaaagcctttgagcaattctaaagacagggccacaataggctctcagtgaccctctgtgactgagtggatgcagcgatgcaaaatctaaccattactgctgaagacaaaaaaaaaaagtcaccctttctacctaggatgagaagccctaaatcagtggggtccacttactaaatagacataaaggaatgaagtgccctggaagaattcctgcctgaacctctcaggagcactcatgtttgaggacacttatcaagtattcactccaggattgggaccatgaaaacttcagctgcttttagctaatcactgtgacttttggggtgtcacagtgcaggcaggaaaggacctgatgaacaaacataatcattgctgtcggagttactgttatttattgccttaatgttacctccttctcctgagcattacatttcctcagtcagtaactcaccatcccctatatctataaagtcacaatccttgagacatgatttctgtttcactttgtagatatgaaacccattcacatggactttttaaaaatcttggcattccaggtcccagacctctgctttttttgggaactactttgtcctaccatcaagtgagtgtttttgagctcactctttggcttcttatgattgcaaacagcagcttagttccatcagtaaaaatgtttctctgcaaaaggaaggtctgaggttttaccctttcagaaacagtgtgtaggcatcacccagagcatggcaatgtttacacaggggctctcttgctaactctcaggaacctcagatttgcctaatttgaacagcccaaatctcaggtagatcagcaacctgatgttcaaaacttgatatgcagactttgtgaacaccataaagaagattttctttttgctccgtgtaggttcccaggaaagtacagtcattgttagtattaaaagtcggaacaggatcccttgattgtggcttgttatctgtgtacatgagagtcaaactttcttctctgtagcaagagctcatgagtagccttttcccccttcctcctggacagctttgaaactcagtttattagggagatcaagtatttaccattgggtcatttgcacctgcttgaatcatctccaacaaatgctaaattccctaagggtttttccatggctctaccttagctcttactccccatgacgtcttttgcagctttgagacacacaaaaaaggggttctgctttacttctttttattcaaaggctgcactttattagtgagtctgaggaaggagtggatgtaactgagatgagatagtggttgtctatcaaacttggatctttttttttatataatactttcagttctagggtacatgtgcacaacgtgcaggtttgttacatatgtatacatgtgccatgttggtgtgctgcacccattaactcatcatttacaaggtatatctcctaatgctatgcctcccaccgcccccaaccccacatcaggccccggtgtgtgatactccctttcctgtgtccaagtgttctcattgttcaattcccacctatgagtgagaacatgaggtgtttggttttttgtccttgtgatagtttgctgagaatgatggtttccagcttcatccatgtccctacaaaggacatgaactcatccttttttatggctgcatagtattccatggtgtatatgtgccatattttcttaatccagtctatcattgacagacatttggcttggttccaagtctttgctattttgaatagtgccacaataaacatacgggtacacgtgtctttatagcagcatgatttataatcctttgggtatatacccagtaatgggatggctgggtcaaatggtatttctagttctagatccctgaggaatcgccacactgacttccacagtggttgaactagtttacagtcccaccaacagtgtaaaagtgttcctatttctccacatcctctccagcacccgttgtttcctgacttttcaatgatcgccgttctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatgagattgcttgtttttttcttataaatttgtttgagttctttgtagattctggatattaaccctttgtcagatgagtagattgcaaaaattttttcccattctgcaggctaccttttcactctaatggtagtttcttttgctgtgcagaagctctttagtttcattagatcccatttgtcaattttggcttttgttgccattgcttttggtgttttagacatgacgtccttgcccatgcctatgtcctgaatggtattgcctaggttttcttctagggtttttatggttttaggtcttacatttaagtctttattccatcttgaattaatttttgtataaggtgtaacgaagggacccagtttcagcttctacataggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtttatgtgaatggattacatttattaatttgcatatgttgaaccagccttgcatcccagggatgaagcccacttgaattgtagtggataagctttttgatgtgctgctggattcagtttgccagtattttaattgaggattttggcatcaatgttcatcagggatattggtctaaaattctcctttttttgttgtgtctctgccaggctttggtatcaggatgatgcaggcctcagaaactgagttagggaggattccctcattttctattgattggaatagtttcagaaagaatggtaccagctactctttgtacctctggtagaattcagctgtgaatccatctggtcctggactttttggttggtaggctattaattattgcctcaattttagggcctgttattggtctattcagacattcaacttcttcccggtttggtcttgggagggtttatgtgtccaggaatttatccatttcttctagattttctagtttatttgtgtagaggtgtttatagtattgtctgatggtagtttgtatttctgtgagatcggtggtgatatcccctttatcattttttattgcatctatttaattcttctctcttttcttctttattattctggctggcggtctgtcaatttttttgatcttttcaaaaaaccagctcctgggtttcactgattatttgaagggttttttgtgtctctatttctttcagttctcctgtgatcttagttatttcttgccttctgctagcttttgaatgtgtttgctcttccttctctagttctttgaattgtgatgttacagtgttgattttagatctttcctgctttctcttgtggtcatttagtgctataaatttccctctacacattggtttacatgtgtctcagagattctggtatgttgtgtctttgttctcattcatttcaagaacatctttacttctgccttcattttgttatttgcccagtagtcattcaggagcaggttgttcagtcttcatgtagttgtgtggttttgagtgagtttcttaatcctgagttctaatttgattgcactgttgtctgagagacagtttgttgtgatttccattcttttacatttactgagcatgctttatgtcccattatgtggtcaattttagaataagtgtgatgtgatgctgagaagaatgtatattctgttgatttggggtgtggagttctgtagatgtctattcagtccactgggtgcagagctgagtggacatgaacattttatcaaagaagaaacacagctatcaaaaatccagaaatattgaaccttgttaataataaagtggctggcctctggttcattcctgtaatctcagtcctttgaaaggctgagaaaggaggatcacttgaggccacaagttcaagaccatcctagacaagtcagttcaagaccagacttcatgtctacaaaacatcaaaaaattagccaggcatggtgatgcatgcctgtcatcccagctactcaggaggctgaggcaggaggattgcttgagcctgggagattgaagtggcagtgagccatgattgtgccattgcactccagcctgggcaatgcatcaagactctgtctaaacaataataataataatagtaatagtaataataataataataaagaaaacggttgggacgccattccttacttattcaatacacaaagttaaaagcaatttctactttctctatttttttattactaaaaaaagctgaaccattctcacagcctgaaatgcttctcaccttcccctcttctatacaaacacttctctgttgatgataatgcagacagtctctcctttaggaatacttcacaccaggtagttccagatccccttatctctgccttcccagagctcctggtgtctccccagttccctctgtgtggtgaagtacccccaccttgggtctcagcatgactcgttctttgaaggtcttgttcacattttcccttatggttctgttcccctgtgttgtgtcacagcactgggcagagtggacaacccattcacaccgatagagagggccccatggttctggagataaccatgtaactgatcagaatagggcattgagggctgggtgtcaggcatgggctgcacttgggtgggcaggccccctggaaagtcacaggatttggcaagcttcctagtaacatctctccctggggtcctcttggaacttcatgcccgatgctggatgctggtttattctcgagagatggttcattccaataatcaatgaaactcatgtcccaactaaagttcataaactccagtttgtaaactgagataatctcagctgaatgaacttgctgaccctctgctttcccccagcctctcagtgcccttgaaatcatgtcagttcaagcagccccatgaggcattacaatgtttagttatttcagtgtttattaaaccttgccctatgctgaccccaggtgaatcacaagctggacttctgacaaggacaagctatgatattcttttcaattacagaaaaagtaagttaactgataggattttttaaagatgttactagttttggaaaggtaatttgtgcacatggtaaacaagaaggtataagaggataatgcttttatactgctgagaataatgttttctctaattttttttggtagatgctttcatcagattaataaaattcactgctgttagttgttgaaggttttttatatcatgaatgggagttgaatattatcatgtattattaatatattattattgaactagcaaaggctcttcctaaaacaattgagatgatcttataatcgttctcctttaatctgttgatgagatcattggtatttatactttttctctgttaactattcttgagtctcaggtttaaattcaacttggtcatggtgtatcatctttgaacactcctgtctctggcttgctactattgtgttcagcatttttgcactgatgccgatgaatgagactggcatgtcatcttcctttgcggtcctgatttttttcagatttggatcatgtggccctcattgaatgagttgggtgtgatgccttctttttcatgtatctggattgatgggacactttggagtctctccagatggccctcaatggtccctgcctcctcattgttaggctcctaggcaaccctttctcatttctggtaggcccaggaacctgtgggttttatgtttgtttgtttgtttgtttgtttgttttttgagttggagtcctgctttgtctcccaggctggggttggagtgcaatggcctgatctcggcccactgcaacctccacctcctgggttcaagtgattctcctgcctcagccttctgtgtagctgggattacaggcatccaccaccactcctggctaatttttgtatttttagtagagacggggttttacaatataggccattgtgatctcttggacaggctagtctcaaattcctgacctcatgatctgcctgcctcagcctcccaaagtgctgagattacagttttgtgcctccacacacagtgaatctgtggtttttaaaagctcctcatgcatgtgaattctgtgagcatcccgggatgacagccactgtgtgtccagctgttaaaactgtgagaaagcaccagcgggaccctctccagcatttgcttgctgtggtcatgaaagaggcttgttggggagatgatgccctggttgactcctgaaggatggttaggaatgcaccagatggaagctgggttggacccagtctatgctaaagaacagcttgtgtggacacaaggagacacgaacacatcatttttgcagagcctggggagtagccaatcgcaccatttgcttaaaacaccgtgtacagttggagaagtggactgagacaggctgaagaagctaacagtggccagatgagaaagggtcttgtgttacttcctagatatacttagattttatcctgtgagtgataggaacagttgcagggactgaagccaaggaagcatgctttaagattccatgttttttgagatgctgtctggtggctgagtagggaattccctggataagtactgcccagggtaggcaaaagaagctaggaggttactgaaataaggagtatgagaaatggtgtaggttttgctgatgttttgtaacacatctcatgacaatcttcatttccttcaccaatttcctgtttcattaattcccttccacgtgctcttctgaaatttgcctcatattctttgatttctcttttacatgttggtttcatcaccttttactttttgctttcctggaaacacaaatgattctgattgtgacatgtcagaattatttgcaacattcccctttctgctgaaacatgagctcactgaatacacaatttagtaaagtgtaggatgcacatgttgttttcatggtcataaccagctctgtagcattttataactacactggcagtgtgctgggaggtgtagagagaaatatttatctcatgtgtggctgacacaacctgccaagttgttttaggagccttcttggaatcccagcaagaacaccactgatgcaatttgaaatcacaatgtcctgctccatgccctggcttcatggcttagtcacgtctgaagtctatttctaactatctgtttccacatctataaagtatgagttaaatcatcctaatactactcatcttacaaagttttcttgctgatattaggagagttgggaaagaactgtataaattatgaagtgccatggagatgttggtggttactttatcaagaaatagacactccagaatagagtagaaagaaaacagttatgattaagtcctcctcctcttctttttttttaatttacaaagaaaggtttaattgagtcacagttccatatggttggggaggctcagaaaacttgcaatcatggcagttggcaaagtggaagaaggcaccttcttcacaaggtggcaggagagagagagctcctcttcttttttgttgtaaagtctacagaagtgcatatacttcagggcaagggcaggcagggagaagaaaggacattgcttcaccccagtcctcactgacaagtttgctttgggacttcattttgtcccagcatatgggacagagctctggccactacccattcagaaggcctgagctgcattgctagttccccactaactctgtgtgtccttgggcaaggctgggcttatgtcaaaagattatgaccctgggctctccagctacagaatctacatatgaatcctggctctgctagagcaattagtgacgtaaccttggatgggtcagttaaccttcctgtggcttagtttgctcatctgtaaaatagggatcataacaacatcaataccatgggttgttagacagattgaatcagttaatgcagggtaaatacttagcatgacacgtattcactatcatttccttgagtaaaagctgagtgtgagtgggtgtgagaatgtgtgaaaccctttcactgcaatctcagttaagaaacccatccataatttaaagttcagggcctaaatgggtggttatcttctcccagttgcatcctatcccacctttgctcttctcctgcccgtaggagctgttggtctttgattgggctggaagacctggtggaccctaagtgatctataagagaatgagaatagaggacagggaatgtcttcaaaactcctagagggacacagaggctgagaggcaggcagtcctgcaggggtcttctgattgggacaaggaggaccttggtcttcataggccaattctggtcaatttcccccatggacagatgaggaaacagatccaggaatatccaaggtctcacacttcccatctgtcaagtcttgttgattctgttgtattcatgtctttcaaagagagagagagtttaaggaaagaaagaaggatcaactgtgtctgatatcactgggagcttaagtaaagggttcttttacttcatagcatttttcccaatttgtaattcagtattatttttgtcactgtttagtatctctttgtcctattagagagatagcttcatcaggacaaggattttgattctttaatatttagtgcttgccacatgccctgaacacagcaggcatacagactaaccaacatacagtggcatcgaagtgagacacctacctcctccagtgcctagagtacatgtccatggacctgtcactctcctcaacaccacccctaagcatgaggcccgaaagcattgctaatcccctcctccagccaccaaaacttaaaggccaggtgtggtggctcctatctgaaatctcagaactttaggagacagcagcaggaggatcacttgaggccaggaatttgagacgagcctgggcaacatagctagacaccatctgtactaaaaattagctgggcatggtggtatacctgtagtaccagctactaaggaggctgaggtaggaggatcacttgaacccaggaggtggaagctacagtgagctataaccacagcactgaactccagcctgagcaacagagtgagaccctgcctcaaaacaatttcaaaaataaataaataaaaacaaaacttagataccacgtggtcaccccaacatgcaaaatcaagttttcccctactgagaagaatggggacttgagagctgagttacagagagataatctgcctttttttttttttttttggtttacatcctcaagatcatgacctgtgaaatttgaatctaatacacaaatcattccagagcaatgttgcttctgcctaccacgagtaattcacttggccactggaagtcagaacaagcttcccagaagagaggtaccacttggactaccaatataaaaggatgaaaatatcggagtgaaggtgttccttgcatcactgagtccctggacagcctgtccactcatgctgatatctgagcctaatgcttctctgaatgttgagatttaactttgatccaatgaaaccagaccaagaaagaagaaacgtctttcattgttgataaggacatgatttttctcacaattttatgattatttttccttagctgtcctataattatctgcttatttgtctcttctccatgtgcttagggtacaaagttgaccaagaccaagaataatgtctgggagcacaatactgacagcacagctttaaaaacatgatgaatgctttaatacaggaaatgagtaggggagaggcaagtggtgcttgggtgttcttccaatgcatagtatcttccttgacacagtcagtgcagctctcagtaggcaagtccctacatgttagaagatgttactttctgtggaattaagtggcagaacatgccttcaattattttcctttgcagaacaacaccaatttcattagttaggacagagtgctggctgcatttgaattccaagcaacgattagtctatcactgttggtatagattccaaccagtcacaccacctcctgaagtttgtagggcaggtaaatcttcatcttagaataaaaatcatcttagccaagtaagtgttttagaggaaagaagaaaacataatcgtttccataagagttttgtttctaaaaaaataagaaaggctctttgtttaggtgagctaatgaagttgttgatagttatcagatgacactggaatctttacttgtcagaatgtgttctgtgcacctctcggtgtggcaacatagagagggagatcctccagcaatgccattgatatggtcagaaactgcatctttctttctccctgctgagatggagtcctttgttctagaaaacccagggggtgccactgggagtaacccttgagacaggaacacgaatctcaaccaatttctggttgcagccttgagtcttactatttgccatagtgatgcttagcaaggaatggcaggtgcaccagagcagcagaggacctaatatctcccttcctgttaactttttataatattttattgtgatcagtatcagttgggaagctacttgcagtcactgagcctcagtttctacatctgtaaactggggatagtagcatggccctatttaatgtgctcagcgaagccactgaaaggagacagaaatgtaccagaattccctggacttttatcctacttctcctggggattgtcacccacctacccgtgtctgtcctttgttgctttgacgctgtcacttcttttcttaggtacctctctgtagggctccattattccagggattccagagttacagcacatgcatacctccatccaagcatgtttatttgtctcctgcttcactaggctgtccccaaggaacatgtggctcccggcacatacctggcacaacactgcacatgacattcacccacttggccttgaatctgacaaggaatctggcatgatgttcacctgctgaggccaggtgccgagcagccctggaggcttaggggccagagggatgggaaaaggtgtctttctggggtgagtatcagtttctgcaggagtgctgaacctgagaaagaataaagagagaaggaagtgaacaagcacagcttaaacatcatctgtttctactgagttttaacaactctgagattttgtttgtcatggaatccatttctcaggccaagcagacacagaacttgggtgtgagtgatgataatgagctgatataattttcacaccctcatcactgagatctctcccatcaggaatgggtcacagggctcacaggtggcagcaactgttattacaggcctcatctctaccagctcctggcacctgctctcctcccattagaaaatcctccacttgtcaaaaaggaagccatttgctttgaattccaattccaccctcaagaggctgggaccacctcattggagtccttgatgctgtgtgacctgcagtgaccactgccccattgttgctggctgaggtggtttgggtcaacctggccatctgggcagctgttctcttctcttctttctcccctactgtttccagacatgcagtatttccagagagaaggggccactctttggcaaagaacctgtctaactttctatctacggcaggacttttgaaagctacagaggaagaagcacaaattgatgctattccactaagccatcagctccatctcatccatgccatgtctcttttttaggggtcctcttgccaacagaatcacagaggacaaatctgaaagtgcagagacagcagctgaggcacagccaagagctctggctgtattaatgacctaagaagatggagtggtcaccagaaagtcagaggaagtgacacacaggggcccagcaatctcagccaagtcaactccaccagcctttctggtccccactgtgtgtacagcaccctgatagggaccagagccatgagagtgagtaagaccagactatgcccttgaggagctcacctctgctaagggaaacaggcctggaaacacacaatggtggtaaagaggaaagaagacaatagaactgcatgaaggggatggaaagtgcccaggggaggaaatggttacttctgtgtgagggggttggtgaggaaagactctaagagaaggctctgtctggctgggtatgaaaggatgtgtaggagtcttctagggggcacaggcacactccaggcataggtaaagatctgtaggcatggcttgttgggatgagtttcaagtattctggaatgaggacagccatagagacaagaggagagttaatagattttatgccaatggctccacttgagtttgtgataagaacccagaacccttggactccccagtaacattgattgagttgtgtatgattctacatagaatattaactcaatggaggtcagtgagtggtgtgtgtgtgattatttgccaactgccgaggtggagaagcctcttccgactgcaggcagagcacgggggccctgctactggctgcagctccagccctgcctccttctccagcatataaacaatccaacagcctcactgaatcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctgtgagtaactgttcaggctcctcttctctgtttccttggacttggggtgctaatcaggcctctctttcccttatctgttttgaatagcaaaaaggatgttcaggctggccgtggtggctcacacctgtcatcccagaactttgggatgctgagcaggtggactgcctgaggtcaggagttcaagaccagcctggctaatatggtgaaaccccatctctactaaaattacaaaaattagctgggcatggtagtgcataactgtagtcccagctacttgggtggctgaggcaggagaattgcttgaacctgggaggcggaggttgcagtgaactgagatcatgccactgcactccagcctgggtaacagagtgagattccatctcaaaaaaaaaaaaagagaaaaaaaagaaaaaaaaagattttcaaggagaagtagcttaagtgttggatgctacaaacatatagaggttatgatggatgttttgcagatctataaaggaataaataagcatctcccccattcatctttagtggaaagaagggtttagggacagcattgattaaggataatctaatagacaatggtttgtacccagcttaccaaaccagaatttggattttacatttttccctttaagttgcaggagaagagggtgaatcttctcaccagtgagatcctggcatcctagagcaggtggagagaagagtcactccctactgtgtgtactggaggcttcccgcctgtcacattttacttctaactcaatttcacagttattaagagtaaggaatcatggtcacatggaaacagaaaatacaaacctcgttttaattctttcacagaaaagttagcaattcagtgagttgtggtaacatagtttccatctactggcaatttaacatgaattggtgtggcttaaattcatcctttttaaagccagatttttttggagatagactatttccagcatgttccttctgagtgataaaagagggctattagttcagtatttgtgacaataaatgtgtataagataacctcacctttccagaataatgtcaggaatatgagtctaatgtacaaatatatatctctaggacaagactgcatatgtctttttaaaaatactttcccaagagtttattttaatacccccatttcaaatacacctgcttagcaggttatcctaaactctcagggctagaaagtaagcaagactgtgagccagtgatgatagcaaaagcatccaggtaggatcaagatgaagtgagaaaatattccttacccctcagggtagaactccaaatagatattcatgggtcctggccccctagtggaggtcacttgaaggacaaacatgttggcatctcatctgcttgaagcctggacacaagggcaccatcagtgtcactctgtgtgtggctggccatgttgtggggctgtcactacagattctggcagtcaggcagacaataccttagccttagacgatgccggtacagcccaggattcagaagctatagtgtagaccatgcccttcttaggcctatacaattacatgcaatagatgatggatttttctgttagcctcttcattgtaaccaaaagcagcattactctaccaaacagaggggagctggaaagaaactaaacagtttgccaagcacagcctctgccttgacgtggaatcatgtgaatctagacactcacctagatctttcctcgggggccaatgctgctcacacattaactcaatagtttgtcctggcctgagagatcatgtaacatgtagaaagtttagaagcagagattagtgccattgattttccatggctgtgacaacaaaggaaggaacaggagtgggaaaacccaaggccaccctggttgtggtagatggtgcacacacttccactaactattctggggcaaggatccaaatgcactattgggcctggctatgctgtctctgctgggttctccaaacacgagcctccatgctgtttcttagttgtattttaccacatattatcagagtcactggatttgtacagaatgtttggaacctatactgccttaatggctaccctttaaagaagagaaaacaaggtcttaattcaactatctggaacattttatggttacttatgtggaatactccatcttttgctatcaacaggaaggtacctggccattagaaggtgcctgcctttcagctgaaagcacatatgaggcatatggatccatttatacacaccgtacttttgaaccacattttcctaatttgcctgtctggggccaagcttgtgggactagcagattcatggttgaattgatggctggctacctcttccatcaacttttctgcttcatccagtcttccacccctcagtaacctcaaactgggaaggtcttcagatatccagaatccccagttggggaagtccatacatggcccatcaaagatgggttgcaagcaggcctgctatagggagcagcagccttgatgggttttcctacagagacagttgatgtgcagacgcaataaactgactgctttgtaattgatcaccttgaaaaaaaatgagcatgtctggctgtattagtcttttcttccattgctataaaaaaaaatctcagggtgggtaatttagaaaggaaagagatttaattggctcatggttctgcaggctctacaggaagcatagcgacttctgccgctagggtgccctcaggaaatttacaatcatggcagaaggtgaaaaagaagcaggcagatcttacatgactggagcagaagcaagagagggtggggaggaggtgccacacacttataaaccaccagatctcataaaaactcattgtcaagaggacagcacccaagggggatggtgtgaaaccatgagaaactgcctctaagatacaaccaccatctatcaggccccacttccagaattggggattacatttcaacatgagatttgggtaggggcacagattcagatcatatcactggcactgtgcttatcaggtggatatcaccagttggaaggctagattccacaagaggaggaatgtccttgttcttagttgtgattcttctgcacagtgtcattcaggaaaatatgagtcaatcatcctccccaatagctcaaatcaatcagatcctctgaccacagagactgaggtgtagctaaaaggtgctcgcacttctacgaggccaatggaagcctggagcacagttgtcaatctgtagaaataaggactctgtgactcctccaagacctctctgtgaatgacagtttaagaagggccagatcctaaaacagggtcagagcttagagtgaagggaaagcttaaaagcctctgagcaaattctaaagacagggtcaccataggctctcagtgaccccctgtgactgagtggatgcagtgatgcaaaatctcatcatcactgcagaagacaaaagaaaaattgtcactctttctacctaggatgagaatcccaaaatcagggaagagtccacttactaaaaagacatgagggaatgaagtgcctggaagaattcgttcctgaacctctcaggatcattcacatttgagaacatttatcaaatattcatcccagactggggccatgaagacttcagctgcttttagctaatcattgtaactttttggtgtctcatggtggaagcatgaaaggacctgatgaacaaatataatcattgccgtcagagttactgttattttttattgccttaatgttacctcctttgcctgatcattccagttcctcagtcagtgactcaccagcccctatatctataaagtcacaatccctgagacctgatttttgtttcactttgtagatatggaacccgtacacatggactttttaagaagcttggaattccagggcccacacctctgccttttttgggaaatgctttgtccttccgtaaggtgagtgtttttgagcttcctcttttgcttcttatgattgcaaagagcaacttagttccatcagtaaaaatgcttctcctcaagaggaaggtctgagattttatactttcagaaatagcgtgtaggcatcacccagagcgtggcaaagtttaccctggggctctcttgctaactctcaggaacctcaagtttgcctcagttggacagcccaaatgtcaagtagatccagcaatctgatgttcacaacttgatgtgcagactttgtgagcaccataaagagcatttcctttttgctccaggcaggttcccaggaaggtacagccatacttagttagtattaaaagtaggaacaggagcccctgattgtggcttgttatctgtggacatgagagtaaaactttcctctctgtagcaagagctcatgaataggcttttttcccttcctcctgcacagcttggaaactcagtttattagggagatcaagtatttaccattgggtcatttgcacctgcttgaagcctcttcaaaaaatgccaaattttgttggggaatttccatggctttaacccaggtcttactccccatgacatctgttgccactttgagacacagaacaaaagtgttctgctttacttcttttcctttgaaggctgcgtcttgtgggtgagtctgagcagggagtggatgtaactgagatgagatagtggttgtctattaacctcagatatttaagcacaatatgaattcatgggtttattttttacacaaaggcagaatcacatgcaaaatcactagaaaggggatgatttgacaaaattattgaatatttaatttcactaaatagaatgtcatatgtgcctcatggactggggactttggtcgagcctttgtgcctaaccttatctgatgctgtgttcagggcctggtccctggatggaaaattatgagcttatttccacagggccagcagcagcaggagtcagctctctggcttagacaatctgacctgcatacctgaggcttgtttctcagattctagttctcctaagtgagggctttgttgtctaattactgcccaggaatttcatattttttccctctgcaaaagcaataatttccctactttcacatgcgtccgtgtgaggagaccaccaaacaggctttgtgtgagcaataaatgtttttaatcacttgggtgcaggccaactgagtctgaaaaaggagtcagcaaggggagataggggtggggcagttttataggagtggggtaagcagtggaaagttacagttaaaggtggttatccattgtcagcagtggagggggccacaaggtgcatggtggggagatcataagactcattgtgcagagaagaatgtcaccaggttgattgatcaatcagttgggacagggcaggaacaagtcataatggaatgtcgtaagattgctcaatcagttaagacaggagctggctgtttcatttcttttgcagttttcagttgcctcaggccatctggatgtacatgtgcaggcttgggctcagaggcctgacattcctgtctttttatattaagaaaaataaaacaaaatagtggcaaagtgttggggcagcaaaaatttttggggggtggtatggagagataatggatgatgtttctcagggctgcttcaagcgggattatgggccatgtggacaccttaaagaaaattttataatgagttacaaggaataggaatttaggctgtggggagatcttggggcagaggatggtaccatggacttgttaaaagtaatatttgttgtatagaataattggtgatagtctgaatgtgtttttatattaattgagaaaccaattgaagacacaagtcccgaataacagaaggagaaaaacaggtaccagaggactaagaatagggaggagctaagacacccagttagaaagtgtccaggtgggtccaaaataagtatttgcctggctggtgagtttttggtctttatctttaagcttttttatattgtcatataccaggccagattggtttagataaaaacaacattcttcatttaaaaatatagagtactcctttttcagcagtgagtaggtcaaggcctcagcgatgttggaggacgactagggctaagaagtcaacctgggtctgaaggactgataaagtttgtgatgtatctgtaatgctagcagaaaagtcattagaaaggctacagaaagttgtgacagaagttgaaatacctgctattccagctccaagggcaatagtggaagcagaaagtcctaaccctacaagtagagggattagaggaataactcatttttgtctggttggtgtcatgagggggacaggaagttgttccgtcccatttgcaaattgaattttttcaatttgggaataagaaatactagtgtacatgtacctgtccaattagcagatagacatatgtacgtggtggagccacagaggaagcagaggccttgtgtgaggcaaaactggaaatgcaaagtgaaaagatgagagggagtgccaaaagaggtgtcttgcacccagactcttagggatttagtgagggcatcagcccttagtggtcataatggggattgatggggcaactgggtatgagaaagagcatagtgtctacaaccaaactttcattgctattcatggggttcggtataagtaaacaagaagggggaatgggaggagagtctgaagaacaaggggaaggtagccaagaatggagtgaaatacagggcaaatgtcttaagggaaatgagaagttctaagagggggctagttgcttgtaacctacatggaagaggtcatgaaatgacaacagaatagaatgggcctgtgagactggaaggagatatttttcttggtctaagaaccatcttccttgagtggggagggattgatagatggaaacttcagtgggagagtaaataggagtgactgatgagaaggagaaaaactggccatgagggacagaagtaggaatactggttgcttctttagctgtcttatcagcataattgttgccttgagcaatggggtctgaggccctttgatggcctttgcagtgaatgactccagctttttttggaagtaaagtggccttgagaagaatttttattaaagaggcattaatgatggaggacacttgcatagtgaagaaacttctttcagcccatattacagcatggtggtgcaggatatggacagcatttagagtcagtataaatattgatgtgtagtccctttgcaagagtgaggccccaagttaaggcaatgagtttggcttgctgagagatagtggaggggggcagagcagtagcctcaatgatagatgtggaagataatatagcacagcctgcctttgctggtgagtggtgattaggcctggtggaactgccatcaataaactaactgtgattcaggtgaaaaacaggaaagaaggaaatatggggaaatagagtgaatgtcagatggatcagagagatacagtcatggggataaggtgtggtatcaggaataatgtgggaggccagattgaagcccaggccaggtacaatggtaattgtgggagactcaacagagagtgggtattgctaaaggagctggggaacagaaagtatatgcatcaggtgtgaggaaggaaatatattttggaagttatgagaactgtatggagtgagttgagcatagtttgtgattttgagggcttctaaaagtattagggtggtggcagccactgcacagagacatgatgaccagcctaaaacagtaaggtcaagttgtttggacaaaaaggctacagagcacggtcccagtccttgtgtaagaattccagctgcacagccctgcacttcggctgtgtgtaatgaaaagagttgggatgagtcaggaagagctagtatgggagcagcctctagagctgtcttcaaggaatggaaagaggagtgaggaaaggatttaggacttatggggtcagctaggtttccctttgtgagtttatataatggttttgttaggatggcaaaaccaggtatccaaaggcaaaagtatccaaccatgcccaggaaggaaaggagttgttttgtagaaggggttggggtttcagagatcagccagacatgatcagcagggagagcccatgtgttttcatgaagaattatgctgaggtacgtaacggatggagaagaaatttgagctttggagggggatacccgatatcctttggagagtaaatgttgaaggagcaggagggtatcttgttgaaaagactcaaaggagggactacagagtagaaggtcatcaatatattgaataatgtgggaagcagagggatgggaagaaagtaaatcatgagagagagcttggctgaagtaatgagggctgtcccagaagccttgtggcagtacagcccaggtaagctgctgggactgatgggtgtcagggtcagtttaggtaaaagcaaagagaggctgggatgtgtggtgcaggggaatagtgaaaaaagcatctttaagatcaagaatggaatagtgagttgtggagggagatattgagaacaaaagagtgtacgggttgggcaccacagggtggataggaaaacaattttgttgataaggcgcagatcctgaacaaacctgtaagacttgtctggtttttagacaggtaagatgggggaattataaggagagtttgtaggctttagaagcccatgctgtagcaggtgagtgataacaggcttcaatctccttaaagcctcttgtgggatgggatactggcgttaagctgggtaagggtgattaggctttaatgggatagtaatgggcatgtgatcagttgccagggagggagtagaggtgtcccatacctgtgggttaaggtggggggatacaagaggaagacacgaaggaggctttgggttgggaagaaggatggcaatgagatgtagctgtagtccaggaatagtcagagaagcagataatttggttaaaatatctcagcctaataagggaactggcaggtggggataactaaaaaggagtgcataaaagaatgttgcccaatttggcaccaaagttggggagttttaagaggtttagaaacctggccgtcaatacccacaacagttatgggggcaagggaagcaggcccttgaaaagaaggtagtgtggagtgggtatcccccctatcgattacacaggggatggacttaccctctgctgtaagagttacctgaagtttggcatccgtgattctccggggggcttccgaggtgatcgggtagcatcagtcttcagccactaagccaaggagatctgggaaggagtcagccaagaaacattgggtttgagctccaggaactttaggagcagtggcgatgtgagtcagacagtccaacctctaattggagcccacacagacagggcacggcttaggaggaatcccaggctgtgggccttctgaggcccagtggccaggcttttggcatttgaagcaaggtccatgaggaggttttgaaggagcccctgggagctgtggcttggatgttctgaaggttttgtatgctggagacatggtcgtgggttgtcttacactggaggcaagtagctataattcagagatgcattgtcacttggccgcctcttctctattatgatacaccttgaaggtgaggctatttaagtcctgttgtggggtttgaggcctggaatccaatttttggagattttttctaatgtcaggagaggattgggtcataaaatgcatattaaggataaggcggccttctggcccctctgggtccagggctgtgaagcatctaatggtaggtgctaagtgggccatgaactgggctgggttttcatctttaccttgggtagtttcctttagcttgtcataattaacagccttgtatgctgcttttttgaaccccttgactaggcaggagaccatgtaatctcacctagctatacctggggagtccatcttgtactgccaatggggatgctcttggggaactgccctgatgccttcttgaaggtctggctcatggcactggtgggtgtcagtgtgagattgggctagggtatcaactctttcctgctcatctggggagaggggggaggtcaggatgacatttcagtcactccaggttaaatcgcaggactgagttaaatattggaattcctgtatatatttagtggggtctgatgaaaaagagcctaaacgctgactgatctgggagaggtcgatagagaaaaaggcacatgtaccttgactatgccttcagctccagccacctgactaagaggaaattgttgggcaggtggaggtgggctagtctcggaatgaaactgtaaggtggagtgggtgtgaggaggggaggtgatacttctattatagggtgggggagcagaggatgaggaagaattgggacctggcttggcctggtgaggagcagcctggtggggaggggagaggtcagatgggttcatagaaaaggaggattcaaaggactcagagcttagggtggagactgaagaaagagacaggagagaaagaagaaagatttgggatgagtcacactgggagcagagactagggagagactgatgtataaaagaatgcctggatgtcaggcacctcagaccatttgcccatttttcaacaaaaatcatccaggtcttataagatcgagaaatcaaaagtgtcattttctggctatttggaaccattgtccagtttgtattgaggccaagcggtattgcagaagaaaataaggcatttaggttttaggtcaggtgttagtcaaagggggttttaggttttgaagaacacaggctaagggagaagaagagggagtggaggctggaaggttgcccatagtgaagggggcaagcccagagaaaagagaaggtagagacatggagagaggggggatggtacttgccacccagggaaggtggtgcttgccacccagggaaggtggtacttgccacccagggaaggtgatacttgtgacccaggggaggtggtacttgcgccaaggtgaatgatcaaggcaggcatccccacagtgatcagatacctctgaaatgtgggtgaataaccaggcaggtgtcctggcagtgatttagacaccaagggaagactgttcccgagtccatgactggcgccagagttttgagttcatggataaaacgtatctcctctgtctctaccagaaagggaaagaaactgaaattaaggaagggagagattgaagggtggagggatagcaagagaggttggagaagagaataaaaagaggccgcttacccgatttaaaattggtgagatgaccttgggctggctggtctgaggacccaagaggtggatctccccatggagtgagggcgaggacaggggatgggactcccgaaggagtccccctgtcccaggtctttggcaccaaatgtcatttgcgtccatgtgaagagaccaccaaacagtctttgtgtgagcaataaagctttttaatcacctgggtgcaggctgactgagtccgaaaaggagtctgcaaagggagataggggtgggtcagttttataggactggggtaagcagtggaaagttgcagttaaaggaagttatctattgtcagcagaggagggggtcacaaggtgcatggtagggagatcataagactcattgtccagaagaagaatgtcacgaggtcgatcaatcgatcagttggggcagggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggttttttttttaagtttcagtgcaaactcggagcaagtgtcataattttctgtctccgatgtgtagaggtgacattttctcagaactttcacgttaagctggaaaactggaaagcgagtccactttgtcattctgtcactcactcattttctcactcaacaaacatgcctcacacttatctaaatctgctagactaaaagaggtccctggtgtctgtaactttctaattctgctagaattctagagtgagctcatgaaataaatgaaaaggatgaagaacaaagagaaaaaagactgcacgttcccttctggcgctcactcacattccctcagcctcagtttctccacatgcccctagaggtgatcattcaaggatttatgagattttagagacaacacatgaaaaagcaaagagacatcagaaagacaaggagttacttagtatttatacacaaggataagacattcagtatcgacaacacttaaagaaaattcaagagtgattttaaatttcccatttcaaatacctcctctattttgtttcctttctcttatgacatctctaaataagcttcctctaactgccagcaagtctaatttcattggatttgactgttttcaaccccaattagaggcagggttaagtacacttaaaataataatgaaatattattttgtttctcctcccagggctattggacgtttgacatggaatgttataaaaagtatagaaaagtctgggggtgagtattctggaagattccattggatagacttgtttctatgatgagtttaccccactgcacagaggatagtctcagcccagagcctcttgcgatgaagctcttgccagcctaactacaaacagagaggttttctgaaagaagaagatatgtatttgggagaagagtattagaatgggaaactgtgtgccattataagctatgtgcaaattcagggaggtaaaggaagacaaagatgttccacagaaaatatgaggaggacttcatgtggattttgaaatagttctccttcactacaaagatcagtaacaagggtgatgccacaccaaggttggacaggcagttgctgggcaggtgtccttgcagaaatatttttgtgtaaggttgggttgggctttctgcaagctggtggttttgccaagtattttgtgatagttttgttatcaggcacacaagcatgagaatccactcatcatagccttctttgatttatttgtcaaggtttttaatcacacacataggcacacagacacactgacacacacacacacacgtgtcataattttggttctcacaatgttcacactcgctattgtaaaacaactttttgagatttgtcctaccaaggatcccatatgtcaccaggtgttgaggtcttcggtctaaactaggctgagaccattgtggttaccacttttctccaagctttggtggcccagggactcccagcatcacgttctgtccagtgtctgcctattcccttcttctttttttcttcccttgatgcccttttatcacatgcattgtctcagacccttcgaatatgtgctcataaatgcatggcatcatctccttcccacatcgattcactttcaattaaaagccaaaactctttcatttcaactttggatttaacatgcttttgaaagaagggttgagaaatatagagaaacagattgggaaaccatgctctgctgtttcttttttttaaactttctatgtaagtgtggaatttttcattctgttttattattaactttaagccaagactttttaatagaaggatatataaatacatctttgtctatacatttctgctgaatttgaagaaatgctgaatattcttaaaccattgtgttccctggtgggctgatggactgtgattttataaggtggcctcagccaactgcagcagctgttccctgtcagaggggctagaggtttggcaagagcggtggaagaggtgcagtggtgtgttcgttcactagaagcatcagggagaaggttttgcctgtttgtatttcatcttctctcatcaagtcctcagaaaccacagtgctgtctgcagggtgctgtggatctggcatggcccatacaggcaacatgactgagtagaaaggacacacagctctggatgtccttgggccccacagcaactgcccttgaaacatttagtccttgtgagcatttgatgatttacttgccttcaattttccatggacctaatactctttataaagggaaatattttaaacctatgaaacattgtggagaatggcatgggaaatacccatgtatgcaccacccagcttaacaaatgctctcctgtcatttctaaccacaatctctttgaagagctcttttgtctttcaatctctcttccctgtttggcccacattacccttcatcgtatgaagacttggatggctcctgtgtcagactcttgctgtgagttatacctaatgaactagaacttaagattactgtgtattgtacatctagaggattatgtaatgtccggatcaaagtctggcttcctgggtttggctccagctgtagcataaggctgttgatgtttaatcaactctgttttctccacacagtatttatgactgtcaacagcctatgctggctatcacagatcccgacatgatcaaaacagtgctagtgaaagaatgttattctgtcttcacaaaccggagggtaagcatccattttttgaaattaaaatactcattgattgattaaatttttattttaaaattcttatatattcatagacagttgcctaaaaactgtgcaggaaggttccatgtacacttcatcctgcccatcccccatggtaacatcttgcaatcttgcataactataaatacagtatattcacattactgcagtacaggaaattaacattgatacagttcacagagtttattcagatttcaccagttttatgtgccctcatttgtgtgggtagttttttgtttttgtttttgtttgttgtttgttgtttgtttttcggactgagtcacactctgtcacccaaatgggagtacagtggtgtggtcttggctcactgcaacctccacctccagggttcaagtgattcttctgcctccacctcccgagtagctgggactacaagttgcaccaccacgccctactaatttttgtatttttagtagagacgaggtttcaccttattggccaggctggtcttgagtgtgtgggtagttctatgcaaatttatcacatttgtagatttgtgcaatgaccagcatgatcaagatgcagacccattccatctccgtatggctccctgctactatcctacagtcacgagtgtttttctctgagagggtctttatcagggaaaactttttttattttgaggaggccaatgtattaatattttttttatggattgtgcttttggtgtcaagtctgaaagttctttgcctagccctccttcctatattgccaatttttctaaaagtcataaagtttaatgctttactaaatgtaactctactatctattttgtgttattttttgtataaggtatgagatttagatcaacgttcattttttgtggcttgtagttgtccagttgttccaaagccatttttggaaatgtgggcatattgttaaaaattaattgggcatgtttctttgcatctttcatttgctattctgtcccattgatcactgtgcttattcctccaccaacaacaaactggtgactctaatacctgtacagtaactcttagcatcatgtagagtgattcttcccacttttatggatgtattttttcagatttgttttagctcttcctggtcctctgcttttccataaaaattcagaatgagtctctcagtgtctataaataaacatgctgttattttaacaagaattgaattaaatgtatagatcaatttagggaaagtctttatcttcactatgtttggtctttcaattcatgaacatagtatgcctctccatttccttagattttctctgattgcttttagcaatttgtagttttcagcatagagatcctgtgcatgttttgttggatttacagctaaagtatttcatttttgttggagtgattgtaaatgatattatgtttttcttgtattttcagatattgattgttggtacatagaaacatgcttggcttttgtttgttgatcttgtatcatagaaccttgcagagctgacttagtatttctagaagtctttttgtatattcttgagattttatacattgacaattatgtcacttgaaaatagagacaattcttttatttcctttccaatctgtatgccttttaattctttttcccagtataatgtcaaataaatgtgttgaatttttgaattgttcctaatattaggaaggaagcatttggtctttcatcatcaagaatgatttagatgaagtgggtttttttgtagattctctttatcaaatggaggaattttctctccctagtttgctgaatttttaacataaaagagtactgtaagtactcattataaaacaaaatatggctgtggaagatgaaagagagtttcaagcatgctggcttgataggccagatccaagctggcaaaaataattatctctttcttctttttttctatccatggaataaaaaattaagaggaaagaatgttaatagaatcgcattatttcttcaaaatacgttgtgagttttaaaagtattatctaccttttttattatactttttttagggtacatgtgcacaacgtgcaggtttgttacatatgtatgcatgtgccatgttggtgtgctgtactcattaactcatcatttaacattaggtataactcctaatgctatccttcccccctctccccaccccacaacaggccccagtgtgtgatgttccccttcctgtgtccatgtgttctcattgtatatttttttaaatctaccacatcaaggcacctctttttcatgttgcccatggtttaggtgaacataaagacagagctcgtctgaggcaacatacagtccaacaaagccacctgcctctctgtctccactctctctctacactgcacgcgtgctaggtgttgatcctgtctattccagtggaagaacaggttccgtaccatgtggagaatttgcatgtaaaaggagactgggatatacaggctggagaccacatcaggtggctgggcatgtgggataaatcctattgagcatctgtcatagggcctgtcacttagtagacagtcactaaatatttgttaaatacatgatgcctgtttaacacattttctacaaccatggagacctccacaactgatgtaggacaaaatctttctgctttgaactctagcctttcgggccagtgggatttatgaaaaatgccatctctatagctgaggatgaagaatggaagagaatacgatcattgctgtctccaacattcaccagcggaaaactcaaggaggtatgaaaataacttgggttttaattagaaacttaaagaatgaatcaggtggggacaggtagaaagtaagatcagagttcctttccgaggagtagtctgctgaatttgagcttcctaaaaatagtctttttatgtacagaaaacacatcataaaattcattacacaatgtcacttattgttccatgccaggcaaagtcatgtccttctgggacttatgtctgcacatttaactatgggtggtgttgtgttttgtgcttagatggtccctatcattgcccagtatggagatgtgttggtgagaaatctgaggcgggaagcagagacaggcaagcctgtcaccttgaaacagtaagtaggagcacagccatggggttctgagctgtcatgagcccctccagctgcctgctatggagctgatactcccgctgttgggttattccagtgaccagacaaaaggagggctgtggtaatgcaacttcaatgggtctcccaagatggggcagctccgatgaggaggtggggcagctggaggaaaaggatcttctcccctgtgcacagaggtcagggtttacatatctgttaaattgtcaccttggatattctggaggactaaatacatcctttagggggaaaagtgtgattgtatcaaagttttaagcatggagtgtatgggatggtggaaggggaaggcacttggtatctgttggttggcagtgagtagggtgggaaagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgccatcagggcaacctcagctcaccacagctggggatagtggaattttccaaagcttgagcagggagtatagagaataaggatgatatttctaggagctcaggacatggtactgttgctttgtaaagtgctgaagaggaatcggctctgggcatagagtctgtagtcaggcaatgtcacctgtcttgagccccttagaaagagtgaatttttctactcttgttctgctgaagcacagtgcttacccatcttgtatcatccacaattaacacatgctactgcagttgtctgatagtggatctctgtctttctatgactaggctccttgacctcagaggtaagtctaactcagttgagtgtctccatcacccccagcggagagccagctgtgtcactgacacctgataatcaccttctgagggagtgtgatgggagatgctccagtaaatagttctgaaagtctgtggctgtttgtctgtcttgactggacatgtggatttcctgctgcacgcatagaggaaggatggtaaagaggtgctgattttaattttccacatctttctccactcagcgtctttggggcctacagcatggatgtgatcactagcacatcatttggagtgagcatcgactctctcaacaatccacaagacccctttgtggaaaacaccaagaagcttttaagatttaatccattagatccattcgttctctcaataagtatgtggactactatttccttttctctccctctctcttaaaaataactgctttattgagatgtaaatcaccatgtaattcatccacttaaaatgtacagtttaatggtttgtagtacatttgaagatatgtacgaccatcaccattgtaaactttaaaacacttctgtcattctagaaacctcatacatgtttagctatcaaccccctgccagaaatcctgttgtcgtatataaccactagtcaactttctgcatctatagatttgcctattctggacacttcatagaaatgatattaatttttcagggtttttttaattctctagttcatgaatttgtactttagtctgtattattttctttcttctgctggcttcaggcttagtttgcccttctccgtttactgtgttgtggcatgaatgtagattattgatttgtgggtttttttcctctaaatttagacattacaactataaatttccctctgggcacttgtttgctaaataacatgacattctggcctatcacatcttaatttttgctcagctcaaaacagtttctatttgcccttttaatttctacttcaacttattggttgcttaaaagtttattgtttaacttccacgtatgtgtgagtttcccaattttcgttaccttattgattttagctttatcctatgataggtgacagagatacactgtgttatttctatctgatttcttgaacagcatgattaatttaagcagcaaattatgatttgggttatcctaagagaccctagcccaatacataaaggcaaagagattagggcattgaattttgttcctttcatcattcaaaagatgcagaaggggctgctgatctcactgctgtagtggtggtccctatgcacagaccttcccttgctcagccactggcctggaagaggggcaaaagtcatagaaggaatggcttccagttgagaacactgatgtatttcactcttctgattggtagagaaaattagaattgctccaggtaaattttgtatgttcacaatggtttcgttttctgttggttttttttttctacagaagtctttccattccttaccccaattcttgaagcattaaatatcactgtgtttccaagaaaagttataagttttctaacaaaatctgtaaaacagataaaagaaggtcgcctcaaagagacacaaaaggtaaaacgtggtggtagttataggaggatgtttagttttcataattttttagaaatatacatatgatcggtgcacttccctgtatgtttttagagaaagattttaacataaagagtacttatgtttagagcaagataattcatttggtaggaatgcagaaagtggagtttgaggaaggagatatgagaatgagtcagagagagcacttaaaatttgatatcaggcacaagaattagtatgccatgacataaatattattcagataaaaccttatcacagcacttcccttcaataaattgtcaaaggataaacattactgtttggaaatacattttattggtattatgctttctctagatcatagattggtaaagagtcatttcaagtacaaggctattattttacacattctccaacaaaaggtcctatcaggccacctgctgaagtgtagtgtgtgttacatttgagccctctgacagcctcgagtgaacagaggtcttctctgggaattgaggctgcaaggctggctaactcagctttgccttcatgagccctggagtccagccaaaagatatctgcaggtcaggggggcaagaaggggtaacccaggtgtcactgaagattgtatagatttggggaatgttgcagtatttgaaagtgctcccaccaaagctgctgacaagttctggaaatgtcaggagaataatctttgtggacattggtgatgaagaagacagaagaataaaaggcccaggacttcttcatgggtatgcagttaggaccagggaaaagaccaaaaagcaattgaacattttagccagatttgtttcaggaaaacatcctgctttccaaggatttagatggatattccttttcactggtgactcaggcaacacccatcagatttctggtctccaaggggctatattctcagaagggaggttgaggactgcacttctgattaacttctgacttcacgagtcactttctgtcaataaaatttctctttttgcttctagcaccgagtggatttccttcagctgatgattgactctcagaattcaaaagactctgagacccacaaaggtaacaaaagagtgcttctgagggctactggtggggcactcagagggaaggttttgttctgaaaatgtgcaggaagtattccaggtagatgagaatttctgccacatagcagaatgacacaggtttggatgttaaaatggtagctggaggcaacttctagaggcatgcaggcatagatagccatgttctaagcttaaagggcaaccctaaggaaaactggcatgccaggaagagtcagcagtctgtggatcacctacataagatcaaatgccagttctcagcctcctccagatccacagaattaaagtttcttcctggaaatttattaggtttctgcaaaaataattgcaatttttgtgattgctttcaatggcaaaaaccgcaattacttttgcagcaacttaatgcatctaacacctaatcaggagccatgctatccaaataagggcgattttaactggcaatttttggtgaaagtgtgttcaccaggttaatcaactatgaagttattttttcctttgcaatggataagtaactttttggaaaacctctgagactgtgtaaatatcctttgtcttcagtctttcacctaccagttttacaacccatgtacgatttttactgaagtcattgttactatgagtggcaaaatgatggccatgttcagtttcaagccaccaagatttggcaatcatgtcacaaaattcctgaatatttaatcattggttctagagagcaggagtaggctgactttggcatagagatttaaatatgtccatgtctacatctacttctgtctgtctgtctatctatctatcatctgtccatcaatcatctatttatctacttactgattatctagctatcatctctctatctatcccaatacaacttgctgtgataaaggaaagagcctactgttttagtgtttcatctagaaatcactagacacatatagctattgagcactgcacatgtggctagtgccactgatgaaaaattttaagttgtatttaagtttaattgaataaaatttgattttaaatagccacatgtcaatagtggctaccacattggacagcagagctctaaactttgagattatagtttggtttcacatcagtatcatcaggttcatggtaacagaatacaattattagatagttgaatttacccacaactgcatcacagaaatcttcactggtaaatcacagctctgttgacatttctcacactcctttcgtattggttttggtggtgagttacatggttggaacaggcactatatttatttctgtgttcccggtctctaaatgtcctaatccagtcctgatcaaacagaccagtgatgggccatcctgagcttctctcaggaaaaaaatcaagagaggggccaacttgcaatcacaagagcttataccattttaatgccattcatcagactgcaatcaatcaccactcatctagctttttgtccatcttcagttgctgtacatcctgagatagtcaattctgagacctatagcctgggtctattacctggtgcctctcaaagatataatccatacttctcaacctgggctatgcacacaaattaccacatcttgtgaaattcagacttgaatcagtagttcaatggtggggtttgagattttgcatttctgtttttgttgttgttgttgttgttgttttgttttgttttgagacagagttttcgctcttgttgcccaggctggagtgcaatggcatgatctcagctcaccacaacctcagcctcccagattcaagcgattattctgcctcagcctcccaagtagctgggattacaggcatgcgtcaccatgcctgggtaattttgtatttttagtagagaaggggtttctccatgttggttaggctggtcttgaactcctgacctcgggtgatccacccaccttggcctcccaaagtgatgggattacaggtgtgtgccaccatgcccagcctttgcatttctaataaggtcacagatgcttatgatccacggaccacactttgagtagcaagaggtggtctgtattccaatattggtctcttaagttccctcaaacatatctaaaggaaaggtcctttaattttccatacatctagccattaatgttgcaaattctctcaaagtttgtcaaggtatattgtagctaaaatgaattacatttttcttgggagagaagactaccccatattaatttacaataaagtacttttaggatcattcaaggagcacaccatgacactgagtatgttatgcagaaatgttctctctggaaattacccagctgtgaaggtggcagggatggcacgaggaggagcggatggtctacgttcttgaagacattgggggaaaactggattaaaatgatttgccttgttctggctctgtaagacacacatcagagtgaaaccacccccagtgagactctgaattgcttttctattttttcccctggggatttgaaggttccacttagatttcttttcatctaaactgtgatgccctacattgacctgatttacctaaaatgtcttttctctcctttcagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggtgagtggacagtacatggagaaggagggaggaggtgaagccttagcaaagatgcttcctcaccacttcccaggagaatttttataaaaagcataatcatgattgtttcattcacaatatgtaggaaggctctcaaaataaaaagaaggaagcatagggaatggttgctattggcagaagtataagatctttgtaaaacagtcctctccctggttcatctgctttctgttaccacaataatgctaagtaaaaaaacatccaaaaacctccctggcatttaacaatatgcatattgctcacacgtcttgatagtgagctctgctgatattggcaggacttgctctggtctggctgtgatctgatggagcctggccctgggtgcgctgtgcaggttgactcagctctgccccacatgtgtctcatgtttcagtcaggtaaccactggtgaagaagcaagctaggaaccagggtatctgacttctgagctaaactcttaaactctataatattgcctttcaaatataacactaagtactaggtgcctatcaaccacactgttttcagacctctgccaaaacttggattctttgtgctatgaagagacatggcttttgggctggtctttgtgtggcagtgaggtgagcacaaagggatgttcttcagagattacagtccagccctgaagcaacaactaggagactgtttcagcaagtgaggacagggctgtgtggggttctatccttttcataactttgcctggcactgaaatcacatgctctgataacatccaccagaactttcttttgtcatatttgggatagaaagggactagtttttcctcaaattattgatagagattttatataatatagtgtttctctccacattttatgtatataacaaaagccctgcttttgtgtatatatgcatatatatatatatacacacacacacacacacatatatataatacaaatcctgctttgtaactgtttttgtttgtatatataacaaaaagagttatgaaccagaagtttggccaataatccttgtcgcacagagaatttgctttttctatctgttttcactttcttggttacagacgtgtaacctcttttttgaatggtgacaatcactttgtcatattttatttgatgctagtggtcatagcctattagtcatgtttgcttccatgagaaagaaaaaccactacatggttatgctaaggatttcagtcattggggttagagccttcccgaatgtctcctgctttcataactcctccacacatcttagtgggccattgagcacatcaaagggcatgacagttattaaaatactttatgaatgctacaatcctttgccagtatgagttgttctctggaacttctaacagttcaacagtactacatggactgagttaaaagttaattcaaaaatctcaatttatccaaatctgtttctttcttttcaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggtaggaggcccctgggaagggagccctccctgaaccagcctggttcaagcatattctgcctctctacaggacagtctgggcttgtacaatcatttgcttgtctttttatgtttaaaaggttttttcaaatcatgaaattgatcattgtcacactttacaaaccacagactagataaaagaaaactatagccagtcacagtcccagcaacttaagatgaaggtcctcaattatgtccttatgggtcataagtgtccaaaatgtaaggactcttttaaaaacacatgatcacaatgctattattatgtcccacaaatgaatattttttcctgaatataatcaaatcttcaggaatcaaatttgaataaaaaacatgcgtctaatcttcaaagaatttataggttagtgcaacagatagacaaagaaagcagtgatgacactgctttccatcaatacagtagcatcatatgcctgtgtaaattatctgacttaaactattctatggaggtgtgggggagaaagaaggagagatggagattagaagaaggaggagaaggaggagagaaggaggggtaagacaaggtagggaggagaaggaggagaattagaaaaacaagagacgagaggagaaggaaagtgcaaaataacaattttgaagtagtgcaagacaatttcttctccttcctcatgaccaacataagggtgacttgaggcaggaatctacttttctgtcagtcattctcatcacttatgtgccttttgtagtgtgaacacatcaccatcctgactataatttgagtgtttagaaataaatatactttgcaacagtatttatctcctctcaacaagactgaaagctcctataatgtaaggagagtagaaaggatctgtaccttacaattctcatagcaaaatatgcatagcaggatttcagtgactagcccacaaaagtatcctgtgtactgctagtagaggggtgggccctaagtaagaaaccctaacatgtaactcttagaggtattatgtctttaacttttaaaatatctaccaatatggaaccaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacaggtcagtcaattttctgcattaataatgttttattaacaattattttaactgaatggtctatatatttaaaaaagaatacactcacttaatcttttaataatttgttctatgggccaaggaatctatttggacccatctatgatctttaagggtgcttcagttctggagttcaaaagctgtagcattaaaaacatcatgcaatgtcaatgtagactagcatgacatgattatctacagtctccttgaacttgagcaaaattaaattcagtttcaagtcaattggaaagatggggaagtattttgcacaatcatgaggtgcacttattatcttgttttgacttttgaatgatgctcttccttcccagaacttgtagaagttttctcatgacagtggctcccaaccactagctgtacattggaatcaccagggagctttaaaaattcatgatgcctggaacatctcagaaattctaaactaatttgcccagagtgtggctttaaaagctcccccattgcttctcatgtgaagccaaggtggaaaatgactaatttaaggtagttctattggatacgaaggactaccacagtccaaggccatccttactgacctcaccttccaggtgcctagctccaaccaactgggctccttttcaactcaattataactctgctaatcttctttcctttcttctcctcattctgttcttatctttcaagtcctaattcaattcccaagcccctccaaggtgtcttcttgacctagtccagggctcatttactcctctgctctgttattagttactggaggctattatcttataatttcataatttgccattaaatcattgagttttgttctctatattttctctttatctaagaatgtcttcccccctccattaacaatatcctctcattttattccatttaaaatatcccagtggtgccttgcaagtgacctcatctaactcaagcatttggtcatttggtaaatgtttaaggagtgatatgcagtcgattggtttgcatacaaatattaagttttttaatgtgaacatttagcaaatgacattcatgtatttgcatgtgtgtgtgcttgcacatgtgcacatgcatgtctgtctgcagggaaaatatattcatgccttttgaaaatttttaaataatgtgttatatttatagaaagatttggaaccttttctctgaagaagttaaagaacagatgtcattgattcatattaagcaagaccctataaatcttatttctaggtctcatgtatttattaagcaactccacaccttaagcaggctttctacatagaagaggaagaagatagagatggtttccatattattttcatattccacattatttgtggctttaggccagctatgtagctatcctgtatgtgtgctcagacaggagactcagccctgagagaaggcggtcctctggcacacctaggatggggaaggtactcccttggaagtcccaagctggcacttctggatctccatggcaattttcttgcccatcactccatggagatcagaatatcactctattgtgtcccctcaacactgaaggagtgtctcaataagaaaagttgagtcaaaacactgtaggaattgagaggttccccacttgcactacccttgtaaaccaagagaagatgttaaaaaataaaacgataatgcttcctgaaggtgtcttcccatctttacactagatgggttcaattgagaggaattactggactgtggaagttgaagactgtccacataattaaaatgtacaatagctactcaggattaccttgcaagtttcaacatacacaaaattaacttcataagatggtttaaaaagtttaccgttatacctaataatctggtttaaatttttaaaactcatccattttcgttaaaatttaaatcaaaaaagaacacgggttcccatgaatttgtctcaggtcaaacctcacacagaataggtgctccatgaatattttgttaaatgatagatgatgaatgttctcactatccaatcttcacacatcttatagagtaagtataacgaatccaagatttatagtgctgaaagtagtttttatatgtttacaaagcattattgtcagtaatttttttttactttgatgctatactttctacttttgctttatttaatgcttctcaatatgctcgtttaactgttgcagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagtattattggatgtttcctgcacattaaggagaaatctatagaactgaatgactgagaaccaacaactaaatattttgatcattgtaatcactgttggtgtgggaactggagtgcagtggtgcaatcttggctcactgcgagctctgcctcccaggttcacgccattctcctgcctcaacctcctgagtagctgggattacaggtgcctgccaccacgcccggctaatttttctatttttagtacagacggagtttcactgtgttagccaggatgctctcgatctcctgaccttatgatccacctgcctgggcctcccaaagtgctgggattacaggcatgagccacggtgcccagcccaatttgattattaacataggtgagagttaacccactatgactttgcccattgtttagaaagaatattcatagtttaattatgacatttttgatgagacacagtggctcacacctgtaatcccagcactttgggaggccaaggcaggcagatcatctgaggccaggagttcaagaccagcctgaccaacatggtgaagccccctttctactaaaaatacaaaaattagctaggtatggtggcacacgcctgtaatctcagctacccaggaggctgaggcaggggaattgcttgaacctgggaggtggaggctgcagtgagccaagatcatgccactgaactccagcctgagtgacagagtgagactgcatctaaaaaataaaattatgcctttttgtagcacatatattttgtaacatacaactgaagccagtattatattattagttttcatttaatgttttcagcccatctcccctgatatttctgggagacaggaaatatgttttcttacacctcttgcattccatcctcaactcccaactgtctaaatgcaatgaacatttaataaaaaaaacagttgattggtcaattgattggacaacaaggctgaaactactcatttcttttcttttcctatttcttcctttattttccctttctgaataatttagccctagagccattaggtgggtggcagccagatggtggccacacattaaggtagagaagagagtcatggtggttccaagtcagagaccaagtaggatgaggacaaactgggtgttcatgtggaaacagcctgcctgggtgtgggagtccaagcaagcagagaaggggttcatagagaggtgtggcctacaagagcagccagagcctaaatagagcatggagaacccatgtgaggtcaggagggcatccatgagtgggaagtgatgggtgaggtttggttacataaaggggatttatcaaagaagtaaatatattaaggatgatagaagccaggcttctcatctttgaagaacggagtcatggattcagaaagggagaaaactagcatgaatcctatgaaattagattggaatggatgtattcgtgtatattcatacccttctagatggatagatgggtagataggtgatagataacagatatatgatagatatatagatagatgaaatgtatacatgtgtttgtgtgtgtgtacaaaaaaaaccatatatttcctacttctcttcactgataggtctaggtaacaatgacatttcaatagcaatgagcacacttagcgcccaagtcttggcttatgaataccatattccatggaaaggaaccagagctctttagagaaatgcctgattccagggccagggttaagaaggttcaagacaagcctaggacacattttgtgccaggaagcaagaaaatgttcaaatgatttccaagtaatgtttggaaatgatatttgaaaaagaccctccaaatgataactccaaattattttcaaatgatatttgcaaaaacctaaagactccaccaaggaactattagaactgataaaatattcagtaaagttgcagttgcaggatacaaaatcaacatacaaaaattagtagcatttctatatgccaatagtgaacaatttggcaaaaataaaaaagtaatcccatttacaatagccacaaataaaactaaatacctaagaattaacttaatcaaagaagagagagatctctataatgaatactgtaaaacactgatgaaggaaattgaagaagacacaaaaacagaaggatattccatgtttacatattgtaagaatcaatattgttaaaactgtccacactacccaaagcaatgtacagattcaatgcaatccctcaaaataccaattacattcttcaaagaaatagaggaaaaaattctaacatttctatagaaccacaaaatacccagaatagccaaagctatcttcagcaaaaagaacaaaactggagaaatcttattacctgacttcaaattatactacaggggtataataaccaaaacagtatggtgtttgtataaaaacagatacattgaccaatgaaatagaatagagcacccagaaacaagtccacacacctggagtgaactcatttttgacaatgttttcaagaacatacactggggaaaagacggtctcctctggtgctgggaaagctggatatcaatatgcagaagaatgaaactagacccctatatctcaccagacacaaaaatcaaatcaaggtggatgaaagactgaaatctggccaaacacggtggctcatgcctgtgatcccagcactttgagaggctgaggcagacagatcacttgaggtcaggagttcaagaccagcctggccaataaggtgaaaccctatctctaccaaaaaatacaaaagttagctgggcatggtggtgcatgcctgtagtcccagctactcaggaggctgaggtgggagaatcacttggacccatgaggcataggtggcagtgagccaagatcataccaatgcatgccagcctgggcaacagagtaagactctggttccaaaaaaaaaaaaaaaagactgaaatctaagatctcaaatgatgaaactgctacaggaaacattgtggaaactcttcaggacattggtctgaacaaaaaatgctgaagtaataccccacaagcacaggcaaccaatgcaaaaatggacaaatggaatcacatcaagttaaagtttctgtgctgcaaagaaagcaatcaacaaagtgaagacgcaaaccacagaatgggagaaaatattttcaaacactctgacaacagattaacatccagaatatacacagagcacaaacaactctttggaaaaaattcaataatcctaataatcaaaaaatgggcaaaatatttatacagacatttctcaaaagaagaaatacaaatgccacatagttatatgaaaatgtgctcaacatcattgatcatcagagaaatgcaaatcaaaactacaatgtcatctctccccagctaaaatggttttaatccaaaagacaggcaataacaaatgccagtgagaatgtggagaaaagggaattctcgtacactgttggtgtaaattattacaaccactatagagaacagtttggaggttcctcaaaacattaaaatggacctatcataagatccagaaatcccggtgctgggtataaaccaggaagaaaggaaatccatatattgaagagatatcttcattcccatgttcccaatagctgctattcacaaatgccaagatttggaagcaacctacatgtccatcaacagatgaatgggtaaagagagtacttcacttatgcacaatggagtacaattcagccatgaaaaaagcatgagatcctgtcctttataataacgtggctggaactgcaggtcattatgttaggtaaaataagccaggcacacaaagacagacattgcatgttctcacttatttgtgggatctacaaatcaaaacaattgagctaatgtctgggtcttagtcaattttgtaccctaagtacagggagcacagccattagaatacatgatgaatgctttaatacaggaatgaataggtgagaggcacagggtggttgggtgttcttctgatacatagtatcttccttgacacattcagtacaactctcaacaggtaagtctcttcatgtatgttaccttctgaggaattaagtggcagaacatgccttctattattttcctttgcagaacaagaccaattgcattagttgggaaacagtgctggctgcatctgagccccaagcaaccattagtctattgctatcaccacagactcagaggggatgacacacaggggcccagcaatctcacccaagtcaactccaccaacatttctggtcacccaccatgtgtacagtaccctgctagggtccagggtcatgaaagtaaataataccagactgtgcccttgaggaactcacctctgctaagggaaacaggcacagaaacccacaagggtggtagagaggaaataggacaataggactgtgtgagggggataggaggcacccagaggaggaaatggttacatctgtgtgaggaggttggtaaggaaagactttaatagaaggggtctgtctggctgggcttgcaaggatgtgtaggagtcatctagggggcacaagtacactccaggcagagggaattgcatgggtaaagatctgcagttgtggcttgtggggatggatttcaagtattctggaatgaagacagccatggaaacaagggcaggtgagaggatatttaagaggcttcatgccaatggctccacttcagtttctgataagaactcaggttccgtggactccctgataaaactgattaagttgtttatgattccccatagaatatgaactcaaaggaggtaagcaaaggggtgtgtgcgattctttgctactggctgcagctgcagccccacctccttctccagcacataaacatttcagcagcttgacctaagactgctgtgcagggcagggatgctccaggcagacagcccagcaaacaacagcacacagctgaaagtaagactcagaggagacagttgaagaaggcaagtggcgatggacctcatcccaaatttggcggtggaaacctggcttctcctggctgtcagcctggtgctcctctatctgtcagtaactgtccagattcctctcctctgttaacttggacttggggtgctactcaggcccctgttccctcatctgttttaaagatcaaaagagatgttcaaggaggagtagcttcttggatgctacaaacacatagaggttattattgatcttatgcagatttatgaagaaataaataagcatttgtcccagccaccttctaattttggtgactaggagggtttggggacagcatttgttagtgggaatgatttgattagcttagatttgacctatactaatcaatgaaaatgaaaacccagcaaaggcagattacaaactgctgaacaagacgagaagtgtgatcctcatccccttcccaggttctcgggattctgggggcaggagggagcagcttgggtttttgtctcattaccttcattttctgggttctctgtctgctggaagagatgtgtagaagtttttcctctgtggacctggtggttcctgctcccctaacttccaccccaggatatcatttacataacacaccggggaacaccaagacttcacgggaagctgtcccctggctctttcctctttcctgtgccatgtcccaaaacatcccctccctcctatgactcactcctcaccctgtcatacacagaactatttaccttgcaatgattaatctccagagcaaaggagacttggaggaagttttgaagatttattctttgctttaatctttttcctcccgtctctgggaggctagcattaatatagagctttgtttctcagctaatgggaatctgctagcagcctgaaaaggcaggagctgtgaaagccaatttggattttacacattttttcccctttgtgttacagtaaaggaggatgaaccctctcactggtgggactcctggcatcctagagcaggtggagagaagagttactttccactgtggttagtggaggctccacctgtcccattaacttctacctcaatttgacttttaagagcaggcaacaacaatgacatgaaaataggaaatataaacttcattttaattttttcacagaaagcttaggaattcagtgagttgtggcaacatggtttccattgtctaacattttaaaatgaattgatatggtttaaattcattcatttttaaatcagaattttttggagatggaatatttccagcatgttccttctgggtgatgaaagagggctgttagttcagtatttgtgacaataaatgtgtgtaaaataacatcacctctccagaataatgtcaggaatatgagtctaaagcatgaatgtatatcgctaagacaagactgcgatatacatatttatgtatatctttttatatttaaaaagatatgtctttttaaatatacatgtctgacagtttattttaatacctcctttttgaatatacctgcttagcaggttatcttaaactgtcaggcaggggagtaagcaatactgtgagctagtgatgatagcaaaggcatccacgtaggatccgtatgaagtaagaaaatattcctcagctctcagggtagaactccaaagagatattcatgggtcctggccccacagtggaggtcactcaaaaggcaaacaggttggcatctcatctgcttcaagcctggacacagggacatcaaatgtgtcactgtgtgcgtggtctgccatgttgtggggcggtcactacagactcgggcagccaggcagacaatgccttagccttagacaatgctggtgcagcccaggagtcagaaactgtagtgtagaccatgccctccttaggccaacacaattacgtgcaatagatgactggcttttctgttagcctcttcattggaaccaaaagtggtattactctaccaaacagaggggagctggaaagaaactaaacagtttgcccagcacagcctctgccttgacatggaaccatgtgagtctagacactcacctagatctttccttgggggacagtgctgctgacagattaactcaatagtttgtcctgacctgagagatcacgtaacttctagaaagtgtagaagcagagattagtgtcattgatttgccatagctgtgacaataaaagaaggaacaggagtagaaaacccaaggccaccctagtttcagtagatggtgcacacatttccactaactattctggggcaaggatccaaatgcactatatgctgcctctgctgggatctccaaacacgaccctccatgccatttctcagttgtattttaccacatattatcagagtcactggatttgtacagaatgtttggaacctatactgccttaagtgctacccattatagaagagaaaacaaggtcttcattcaactgtctggaacattttatgtttacttatgtggaatactgtaccttttgctatcaacaggaaggtacctggacattagaaggtgcctgtctttcagctgaaagcacacatgacgcatatggatccatttatatacaccatacttttcagccacattttcctaatttgcctctctgggaccaaccttgtgggactagcagattcacggttgagttgatggctggtgatgtctgccatcagcctttcttcttcctccagtcttccacccctcagtaacatcagactgggaaggtcttcagatatccagaaccctcagttgggggagtccatacatgacccatcaaagatgagttgcaagcaggcctgccatagggagcagcagccttaatgggttttcctacagagatacttgatgtgcagaggcaataaactgactgctttgtgattgatcaccttgaaaaaagtaagcatatctgggtgtattagtcctttcctacatcgctgtaaagaaatacctgaggctgggtaatttataaataaaagagatttaattggctcatggttctacaggccctacaggaagcatagcgacttctgcctctagggagccctcaggaaattttcaatcatggcagagggtgaaggagaagtaggcagatattacatggctggagcagaagcaagagagggtggggaggaggtgccacacacttataagccaccacatctcataaaaactcattgtcacgaggaaatacccaaagggggttggtgtgaaaccaggagaaactgcccctaagatacaatcgccttccatcaggccccaccaccagcattggggattacatttccacatgagatttgcgtaggggcagattcagaccatatcactggcagtgtgcttattatcaggtgaataccaccagttggaaggctagattccacaagaggaggaatgtcctggaaattggttttttaagttgtggatcttctgcacactgtcattcagggaaatatgagttaatcatcctccccaatagcgcaaatcaaccagatcatctggccacagagactgaggtgtagctgaaaggtgcttgcatttctacgaggccaatggaagccttcagcacagttgtcaatctgtagaaataaggactctgtgactcctctgacacccctctatgaatgacagtttaagaagggccagatcctaaaatagggtcagagcttagagggaaaggaaagtataaaagactcttcacaaattctaaagacatggtcaccataggctctcagtgaccctctgtgactgagtggatgcagtgatgcaaaatctcatcatcactgcagaagagaaaaaaaaaaaaaagtcaccctttctgcctaggatgagaatccccaaatcagggaagagtccacttactaaatagacataaggaaatgaagtgccctggaagaattccttcctgaacctctgaggagcactcacgtttgaggacatttatcaagtattcattccaggattgggaccataaagacttctgctgctttcgactaatcattgtgactttttggtgtctcatggtggagacgggaaaggacttgatgtacaaatataatcattgctgtcagagttactgttatcatttattgccttaatgttacctccttctcttgagcattccagttcctcagtcagtgacttaccagcccccatatctataaagtcacaatccctgagacctgatttctgtttcagtttgtagatatggagcccattcacatggactttttaagaagcttggcattccagggcccacacctctgctttttttgggaactactttgtcctaccatcaggtgagtgtttttgagctcactctttggcttcttatgattggagagagcagcttagttccatcagtaaaactgcttctcctcaggaggaaggtctgaggttttacactttcagaaacagtgtataggcatcatccagagcatggcaaggtttaccccgggactctcttgctaactctcaggaacctcaggtttgcctcagttgaacagtccaaatctcaggtatatcggcaacctgatgttcagaacttgatgtgcagactttgtgagcaccataaagaacatttttcttttgccccatgtaggttcccaggaaggtacagtcatatttagttagtattaagagtaggaaaaggagcccccatttgtggcttgctatctgtgtacatgagagtcaaactttcctctctatagcaagagctcaggagtagcctttttcccctacctcctggacagctttgaaactcactttattagggagctcaagtatttaccattgggtcattcgcacttgcttgaatcctctccaaaaaatgctaaatcccctgaaggtatttccatggctctaccccagctcttactccccatgacatcttttgcagctttgggagtcagagcaaaggtgttctgctttacttcttttatttcaaaggctgcaccttatgggtgagtctgagcagggagtggatataactgagatgagatagtggttatctatcaaactcagatatttaagcataaaatgaatttgtggttttttttttaaacaaaggcagaatcatatgcaaaatcactagaaaggtgataatttgatgaaattattaaatatttaattttgctgaataaaatgtcatatgtgccacatggactgtgaactttggtcgagcctttgtgcctaacctggtctgatgctctgtctagggcctggcctctggatggaaaattatgagcttatctccacagggccagcagcagcagtagtcagctctgtggcttagatcatctttcccgcatacctgaggcttgtttccctgattccaattcttccaagtgagggttttgttgtctaattactgcccaggaatttcatatttttccctttgcaaaagcaataatttccccgccaccttttctaggtcagttctttagtagatgtaccccccaagataaacattcctgggatctttgtttgcacaggtaaaacatcaaccctgaaatgtagaaaacaggaaagtttgtttttcagtttcagtgaaaacgctgagcaagtgttgtaatttgctgtgtccaatgtgtagaggggacattttctcagaacttccatgttaagctggaaaactggaaagtgagtccactttgtcattctgtcactcactccttttctcactcaacaacatgcctcagacttatctaaatctgctagactaaaagaggtccctgatgtctgtaacttcctaattctgctagaattctagagcgagctgatgaaataaatgaaaaggatgatgaacagagataaaagactgtgcattcccttctgacactcactctctttccctcagcctcagtttccccatgtgcccctggaggtgatcattcaaggatttatgagattttagagacaatacatgaaaaagcaaaaaggcatcagaaagacaaggagttacctagtttacacacaatgataagtcattcagtatctacagcactttgagaaaattcaagagtgattttaaatttcccatttcaaatacctcctctgttttctctcctttcccttatgatgtctccaaataagattcctctaactgccagcaagtctgatttcattggattcaactgttttcagccccaattagacgcagggttaagtatatttgaaatattaatcaagggaagcatttccaagatggccgaataggaacagctctagtctgcagctcccagcaagattgaggcagaagataggtgacttctgcatttccaactgagtcttagcaacaggcagaccaggagataccctcccgtgcctcgatcggcaggtgccacacccacggagacttgctcactgctagtgcagcagtctgagatccacctgatatgctgcagcttgatagaggaggggtatcagccattgctgaggcttgagtagcttactgtgtaaacaaagaggcctggaagcacgaagtgggtggagcccaccgcagctcagcaaggcctactgcctctgtagattccacttctgggggcagggcagagtagaacaaaacacaggagacagacagcctctgcagacttaaacgtccctgtctgacagctctgaagagagcagtggttctctcagcacggtattcgagctctgagaacggatagactgcctcctcaaatgtgttcctgacccccctgtagcctgactgggaaccactttccagtagaggccgacagacacttcaaacatgcgggtgcccctctgggatgaagcttccagaggaaggatgaggcagaaatatttgctgttctgcagcctctgcaggtaatacccaggcaaacagggtctgaagaggacctccagcaaactccaaaagacctgcagctgaggagtctgactgttagaagaaaaactaacagacagaaatagcatcaacatcaacaaaaaggacatccacaccaaaaccccatttgtaggtcaccaacatcagagaccaaagatagataaaaccataaagatgggaagaaaccagagcaaaacagctgaaaattccaaaaaacagagcatctcttctcctccgaaagatcacagctcctcaccagcaagggaacaaaactggacagagaatgagtttgatgagttgacagaagtagtcttcagaaggtcggtattagcaaacttatccgagctaaaggagcatgttctaacccatcacaagatagctaacaaccttggaaaaaggttacatgaatggctaactaaaataaacagtgtcaagaagaccttaaatgacctgacagctcaaaaccatggtacaagaacttcgtgatgcatgcacaagcttcaatagccgattcgatcaactgtaagaaaggatatcagtgatcaaagatcaaactaatgaaataaagcaagaagacaagattagagaaaaaaaagtgaaaagaaatgaacaaagcctccaagaaatatgggactatgtgaaaagaccaaatctacatttgacaggtgtatcagaaagggacagggagaatggaaccaagtcagaaaacactcttcaggatattatccaagagaacttccccaaactagcaaagcaggccaacattcaaattcaggaaatacagagaacaccacaaagatactcctcaaaaagagcaaccccaagacacataattatcagattcaccaaggttgaaatgaaggaaaaaatgttaagggcagccagagagaaaggtcggcttccccacaaagggaagtccaccagactaacagcagatctctcagcagaaaccctacaaaacagaagagattgggggtcaatattcaacatacttagggaaaagaattttcaacccaaaatttcttatccagccaaactaagcttcataagtgaaggagaaataaaatactttacagacaagcaaatgctgagagattttgtcaccaccaggcctgccttacaagagctcctgaaggaagcactaaacatggaaagaaagaactgctaccagacactgcaaaaacatgccaaatggtaaagaccatcgatgctatgaagaaactgcatcaattaatgggcaaaataaccagctaacatcataattgcaggatcaaattcacacatatcaatattaaccttaaatgtaaatgggctaaatgccccaattaaaagacacagactgatgaactggataaagagtgaagacccattggtgtgctgtgttcaggagacccacctcacatgcaaagacacacataggctcaaaataagaggatggaggaagatctactaagcaaacagaaagcaaaaaaaagcaggggttgcaatcctattctctgataaaatagactttaaaccaacaaagatcaaaaaagacaaagaaggccactacataatgataaagggatcaattcaacaagaagagctaactatcctaaatatatatgcacccaatacaggagcacccagattcataaagcagtccttagagacctataaagagacttagactccacacaataataatgagaggctttaacaccccattgtcaatattagacagatcaatgagacagaaggtttattttattttattattatttaagttttagggtacatgtgcacaatgtgcaggtttgttacatatgtatacatgtgccatgttggtgtgccacacccattaactcgtcatttagcattaggtatatctcctaatgctatccctaccccctccccctaccccacaacagtccccggagtgtgatgttccccttcctgtgtccatgtgttctcattgttcaattccaacctttgagtgagtacatgcggtgtttggttttttgtccttgcgatagtttgctgagaatgatggtttccaccttcatccatgtccctacaaaggacatgaactcttcattttttatggctgcatagtattccatggtgtatatgtgccacattttcttaatccagtctatcgttgttggacatttgggttggttccaagtctttgctattgtgaatagtgccacaataaacataagtgtgcatgtgtctttatagcagcatgatttataatcctttgggtatatacccagtaatgtgatggctgggtcaaatggtattcctagttctagatccctgaggaatcgccacactgacttccacaatggttgaactagtttacagtcacaccaacagtgtaaaagtgttcctatttctccacatcctctccagcacctgttgttttctgactttttaatgatcaccattctaactggtgtgagatggtatctcattgtggttttgatttgcatttctctgatggccagtgatgatgagcattttttcatgtgtctgttgggtgcataaatgtcttcttttgagaagtgtctgttcatatccttcacccacttgttgatggggttgtttttttcttgtaaatttgtttgagatcattgtagattctggatattagccctttgtcagatgagtaggttgcaaaaattttctcccattctgtaggttgcctgttcactctgatggtagtttcttttgctgtgcagaagctctttagtttcattagatcccatttgtcaattttggcttttgttgccattgcttttggtgttttagacatgaagtccttgcccatgcctctgtactgaatggtattgcctaggttttcttctaaggtttttatggttttaggtctaacatgtaagtctttaatccatcttgaattaatttttgtataagttgtaaggaagggatccagtttcagctttctacatatggctagccagttttcccagcaccatttattaaatagggaatcctttccccattgcttttgtcaggtttgtcaaagatcagatggttgtagatatgtggcattctttctcagggctctgttctgctccattggccaatatctctgttttggtaccagtaccatgctgttttggttactgtagccttgtagtatagtttgaagtcaggtagcgtgatgcctgcggctttgttcttttggcttaggattgacttggcaatgcgggctcttttctggttccatatgaactttaaagtagttttttccaattctgtgaagaaagtcattggtagctttatggggatggcattgaatctataaattaccttgggcagtatggccattttcacaatattgattcttcctacccatgagcacggaatgatcttccatttgtttgtatcctcttttatttcattgagcagtggtttgtaattctccttgaagaggtccttcacatcccttgtaaggtggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacgatgggtcctggacttttttggttggtaagctattgattattgccacaatttcagagcctgttattggtctattcagagattcaacttcttcctggtttagtcttgggagggtgtatgtgtcgaggaatttatccatttcttctagattttctagtttatttgcatataggtgtttgtagtattctctgatggtagtttgtatttctgtgggatgggtggtgatatcccctttgtcattttttattgcatctatttgattcttctctcttttcttctttattagtcttgctagcgttctatcaattttgttgatcttttcaaaaaaccagctcctggattcattaattttttgaagggtttttgtgtctctatttccttcagttctgctctgattttagttatttcttgccttctgctagcttctgaatgtgtttgctcttgcttttctagttcttttaattgtgatgttagagtgtcaattttggatctttcctgctttctcttgtgggcatttagtgctataaatttccctctacatactgctttgaatgtgtcccagagattctggtatgttgtgtctttgttcttgttggtttcaaagaacatctttatttctgccttcattttgttatgtagccagtggtcattccagagcaggttgttcagtttccatgtagttgagcagttttgagtgagcttcttaatcctgagttctagtttgattgcactgtggtctgagagacagtttgttataatttctgttcttttacatttgctgaggagtgctttacttccaactatgtggtcaattttggaataggtgtggtgctgaaaaaaatgtatattctgttgatttggggtggagagttctgtagatggctattaggtctgcttggtgcagagctgagttcaattcctgggtatccttgttaacttttggtctcgttgatctgtctaatgttgacaatggggtgttaaagtctcccattattattgtgtgggagtcaaagtctctttgtaggtcactaaggacttgctttatgaatctgggtgctcctgtattgggtgcatacatatttaggatagttagctcttcttgttgaattgatccctttacctttatgtaatggccttctttgtctcttttgatctttgttggtttaaagtctgttttatcagagactaggattccaacccctgcctttttttgttgtccatttgcttggtagatcttcctccatccctttattttgagcctatgtgtggctctgcatgtgagatgggtttcctgaatacagcacactgatgggtcttgactttttatctaatttgcccatctgtgtcttttaattggagcatttagcccatttacatttaaggttaatattgttatgtgtgaatttgatcctgtcattatgatgttagctggttattttgctcgttagttgatgcatttttttcctagccttgatggtctttaccttttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttagtttgtctggatatgagattctgggttgaaaattctttcccttaagaatgttgaatattggtccccactctcttctgccttgtagagtttctgccaagagatcagctgttagtctgatgggcttccctttgtgggtaacccgacctttctctctggctgcccttaacattttttccttcatttcaactttggtgaatctgacaattatgagtcctggagttgctcttctcgaggagtatctttttgacattctctgtatttcctgaatctgaatgttggcctgccttgctagattggggaagttctcctggataatatcctgcagagtgttttccaacttgcttccattctccccatcgctttcaggtccaccagtgagacgtagatttggtcttttcacatagtcccatatttcttggaggctttgttcatttctttttattctttttctctaaacttcccttctcgctttatttcattcatttgatcttccatcactgataccctttcttccagttgatcgcatcagctcctgaggcttctgcattcttcatgtagttctcaatccttggccttcagctccatcagctcctttaaggacttctctgtattggttattctagttatccattcatctaattttatttcaactttttaacttctttgccattggtttgaagttcctcctgtagcttggagtagtttgatcgtctgaagccttcttctctcaacttgccaaagtcattctccatccagctttgttccattgctggtgaggagctgcattcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctgacaggaccctcagctgcaggtctgttggagtttgctagaggtccactccagaccctgtttgcctgggtatcagcagtggtgcctgcagaacagcagtggctgtagaacagcagatattggtgacctgcaaatgctgctgcctgatcgttcctctggaaggtttgtctcagaggagtacctggccgtgtgaggtgtcagtctgcccctactggggggggggtgcctcccagttaggctgctcaggggacagggacccacttgaggaggcagcctgcccgttctcagatctccagctgcgtgctgggagaatgactactctcttcaaagctgtcagacagggacatttaagtctgcagaggttactgctgtctttttgttcatctgtgccctgcccccagaggtggagcctaaagaggcaggcaggcctccttgagccgtggtgggctccacccagtttgagcttcccagctgctttgtttaccttatcaagtctgggcaatggcaggcacccctcccccagcctcactgccgccttgcagtttgatctcagactgctgtgctagcaattagtgagactccatgggcataggaccctccgagccatgtgcaggatataatctcctggtgtgccgttttttaagcccgttggaaaagcacagtattagggtgggagtgacctgattttccaggtgctgtctgtcacccctttctttgactaggaaagggaactccttgaccccttgcgcttctcaagtgaggcaatgcctcgccctgcttcggcttgtgcacagcacgctgcacccactgtcctgcacccactgtctggcactccctagtgagatgaacccggtacctcagatgaaaatgcagaaatcacccgtcttctgtgtcactcacactgggagctgtagaccggagctgttcctattcggccatcttggctccaccccccgagttttggcttttaattgaaagtgtattgatgtgggaaggagataatgccatgcatttatgagcacatattagagggtctgagacaatgcatgtgataaaaggtcacctaaggaagaaaaaaagaacaagggaagacactggaaagaacgtgatgctgggagtccctgggccaccaaagtctggagaaaagtggtaaccacaaggctcccagcctagtttcactgaagacctcgacactaggtgacttatgggatccttggtaggacaagccttgaaaagttttacaatagcaaatgtggacgttgtcagaaccaaatgatgtcacgtgtgtatttgtgtgtgtgtgtcagtgtgtgtgtttaaaaatcatgacaaataaagcaggctgtgaagaggggattcccatgctcgtgtgcctgataacacaactatcacaaacgctttgcgaaaccacaagtttgcacaaaggcaatcccaaccttacacaaaaatatttctgcaagggcacctgcccagcgactgcctgtccaaccttggtgtggtgtcacccttgttattgatcttttagcaaaggagaattatttcaaaactgatatgaaatcctcctcatattttccttggaacatctttgtcttgctttacctccctgaatttccacatagtttgtaatggtcacaaactatgtgcatagtcagcaatacattttttgtttactttgatgctacagtttctaattttgctttatttaatgcttctcaatatgcttgtttaactgttgcagatcccgctgaaattacgcttaggaggacttcttcaaccagaaaaacccattgttctaaaggttgagtcaagggatgggaccgtaagtggaacctgaatttccctaaggacttctgctttgctcttcaaaaaagctgtgacctagaacaccagagacctcaaattactttgtgaatagtaccctgaaatgaagatgggcttcatccactgtactgcataaataaccagggattctgtacatgcactgagctctctccctgtctgtgtagagtgttatacttgggaatataaaggaagtgaccaaatcagtgcttgggaagtagatttggcttctttgtttctcacaggacaatctcagccacccctagttagcaccattaactcctcctgagctctgataaaagaatcaaaatttctcaataatttcatccaaaattattaatgaaaataagaattattttgatggctctaacagtgacatttatatcatctgttttatctggagcattctataataagtttatattaagcaaatcaataaaaacctcttacaaaagtatcatcggatactttcctgaacattaaggagaaatctatagaactgaatgaatgagaaccaacaagtaaatatatgtgatcattgtaaccattgttggtgtggggcatttgtcagaactccaatgtgattattaacataggtgagaattaatccactgtgactttgcccattgcttagaaagaacattcatagtttaattatgccttttttgaccaagcacagtggctcatgcctgtaatcccagcactttgggaggccgaggtgggtggatcacctgaggtcaggagttcgagaccagcctgaccaacatggtgaaaccccatctctactaaaaatacaaaaattagctaggtgtggtggtatgcacctataatctcagctacccaggaggctgaggcaggagaatcacttgaacctggaggcagaggttgcagtgagccgagacgcaccattacactccagcctgggtgacagagtgagattccatctcaaaaaaaaaaaaaaaaaattatgcctttttgaagcacatacattttataacatacaactgaatcccttattatattattagttttgatttaatgttttcaaaccatctcccctgatatttctgggagatgggaaacatgttttcttacacctcttgcattccattctcaactcccaactgtcttactgcaatgaacacttaataagaaacagtcaattggtcaattgattgggcaacaggctaaacacactcattccttgtctgttcccacttctttctttactttcccttcctgagtaacttatcctaaagtcattaggtgggtggcagccagatggtggccacacattaaggtagaaaagagagtgtcatgatggttccaagtcagagacctagtagggtgaggatcaagtaggtgttcacgtggagaaacagcccggcctgtgtgtgggagtccaagcaagcagagaaaatgtcgacacagaggggtggcctgaaaaagcagccagagcctaaacagggcatggagaacatatttagggcatgaggtgaggagggcatccatgagtgggaagggatgggtgaggtttcactacataaaggggattgatgaaataagtaaataaagtatactggaagccaggtgtgtcacttttgcagaaaagagtcatggattcagaaagggagaaaactagcaggaatcctatgaaattagattaaaatggatgtatccatgtatattcatacccttctagatagataaatggttagataggtgataaaaagataacaagaggacaagataattagatagacataaatgtatgtatgtgtttgtgtgtgtgtacaaaaaaacatatactccctacttctctccactgatagggctaggtaacaatggcatttcaatagcaatgagcacacttagtggccagatcttggcttattaataccattttccactgaaaggaaccagagctttttagagaaatggctgattccagggccaggattaagaatgttcaagataagcctaggatacattttgtgccaggaagcaagaagatgttcaaatgatttccaagtaatgtttggaaatgatatttgaaaatgatttccaaatgatatttccaaatgatttccaaatgatatatggaaacacttaaagactccactaaagaactattagatctgataaacaaattcagtaatgttgctggatacaaaatcaacatacaaaaaccagtagcatttctgcatgccaacagtgaacaatctggcaaaaataaaaaatgtaatcccatttacaataaccccaaataaaactaaatacctgggaattaacttaagagaaagatgtctacaattaatattgtaaaacactgatgaaggaaattgaagaagacacaaaaaagaaggatattccatgtttatatattgtaagcattaatattgttaaaaatgtccatactacccaaagcaatgcacagattcaatgcagtctctcaaaa

SEQ ID NO: 14434 - DNA, 14699 bp, Human; identical to SEQ ID NO: 12767
  misc_feature (1)...(14699): n = A,T,C or G

SEQ ID NO: 14435 - DNA, 31078 bp, Human
ctgacctcaagtgatcacctgccttagtctcccaaagtgctagaattacagatgtcagccatcatacctggcctggttttttttttttttttttttttgagacggagtcttgctctgtcacccaggctggagtgaagtggcgtgaccttggctcattgcagcttctgccctccaggttcaaggaattctcctgcctcagcctccctagtagctgggattacaggcacctgccaccatgcccaactaatttatgtatttttagtagagacgggtgttgccatgttggcctgactggtctcgaactcctgacctcaggtgatccgcaccttgtcctctcaaaagtgcagggattacagggatggagccgctgcacctggccctggcctgtgtttgtttgttttgttttgttttcaacttttattttcacggagtacgtgtgcatgttggttacatggataaattgcttgttgttgaggtttggtatacaaatgatcccgtcaccctggtagtaaacatagtacctgataggcagtttttcaaccctcactctctcccatccttccctgtctaatagtctccaatgtctgttgttctcatcgttatgtccacgtgtactcagtgtttagtttccactcgtaaatgagaacatgccgtctttggttttctgttgctgtttttttttaggccagagtgcagtggcacgatctcggctcactgcaacctctctgccttccgggttcaagcaattctcctgcctcagcctcctgagtagatgggattacaggtgctcgccaccacatctggctaatttttttctatttttagtagagacagggtttcaccatgttggccaggctggtttcaaactcctgacctcaggtgatccacttgccttggcctcccaagtgctaggattacaggcgtgagccattgcgttgggcctctgttcgtgttaattcgatgaggataatggcctccagctgtatccatgttgctgcaaaagacaggatttcattgtgtttttttttcgttgtttttttggctgctagtattccatgatatattacgtaccacattttctttatccagtccaccatttatgagcatctaagttgatttgatgtctttgctattttggatagtgctgtgattaatatgagtgctcttgtacttttggtagaatggttttattttcctttgggtttatacccagtattgggattgttggatcgacatacatgtgtccaataaatgtatgaaaaaatgttcaacatcactgatcattagagaaatgcaaaccaaaaccacaatgtaaatcaaaaccacaaacccatctcaccaccagttagaatggatattattaaaaagtcaaaaaataacagatgttggcaaggttgtgaagaaaagggaatgcttatccactgttggtaggaatgtaaattagttcagccactatggaaagcagtttggagatgtctcaaagaactatgtttaattttgtgtcctttttttttgaattatgagctatagcatttacccatttataaataataaatgtgatttaaaaacttttgattatgagaaaattgagacatacacagagagatagtacaatgaatcacatgtcactcagctataatagttcaactacgcccatactgactcctcacaagtctacagtttgtcatgtgacacatctataaagcatttttgttcttttacaaatcgtaaaaagacgcttatttttattggtaccaagtttgtgtataagttcatattatttcttggaaatgagaaatggagttctatgaagatttttaagacaattattgagtaaaatacaaagaataagatgacctggcattccatttttttttactttatatatgtgtctaattttcaaatttaattggatgaattttgtaacaaacatctttagataacttacattctaatggtttttacagattattgaataataaaatacagttttgaaaaaaatggatgaagaacctgaaagaactaagcgatgggaaggaggctatgaaagaacatggtaaggagagctttattgccctgtcttttcttttagacaatgtctttttttttctttacaactttattaaagtatattttacatatgttaaaattcacccatttccaatgtacaattcagtgatgttttattaataatttactgagctgtgcagccattatcataaaccagttttagaatattgtaaccactccagtaagatccttcacattcatttacaattaatttaaatcttaatttaattccacctgtgggcaatcattagtctactttttgtctccaaattttaaccttttctggacatttcacaaaaatgtgatcatatacaatcatgtgccacataatgatgttttggtcaaagacagactgcatatatgacaatggtcccataatattataatactgtatttttactctaccttttctatgtatgtttagatatacaaatactgaacattgtgttacagttgtcttaagatattcagtatagtaacgtgctgtacaggtttgtaacctaggcgtgggataggctataccatctaggtttgtgtaagtataccctgtgatattcacacaataatgaaattgcctaacaatgcatttctcagaatgtatccctgtcagtaagcgatgcatgactataatagttggtctgttgtggctggctttcacttatttttaagactcatccatgatgcagtgtgtattaatacttcattccttttttattgctgaatagtattcccatctatggttatgccacattattgtttatccattcactagtctgtggatatttaggttctttacagtttttgactgttaggaaaatgcagccatgaacacttacatgcaaatctttgtgtggacatatattttcatttcatttgggctagtaatcattttagcttgtcttttcaaacaaataattatgacttatagggagattcttaaagaagatgaatctggatcacttaaagctacaatagaagacattctattcaaggcaaagagaaaaaggtatgtaaccttcctatgtatcttaaaaaggtaaaatatattcattttaagcctttctatctataaatactcctcagtacttcattttagctgtgtttcagggtaactgacctattgccttctgactatggggaaagaactagccacctacccttgccccagcaggaaatggtctttagagactgtctacaatacctataattgtgtgtattgtattccataagttaattatttactccactaaaaatgcacgttatgacattcttactcagaattagaaaaaaagaaaaacaaaggaggtcaattggaaagttgtattttttttgtggggggggatagtatatggaattacattaaaatgtttgtataattttaacagagtatttgagcaccatggacaagttcgacttggaatggtatgtcattattttttcttttactagtacagaactagtttaggttagagaaacattctgtcttgctagaaaaaacaatagcaaaacaacaaagtttttaaaagaatatgttaaaaatacgtgcatagaatatgtaattattaaatgccatttttactagtcaaaatggcacttgaggctgggcacagtggctcatgcctataatcccagcactttgggaggccaaggcaggaggattgcttgagcccaggagtttgagaccaacctgggcaacagaacgagacccagtttctacaaaacaaaacaagtacttgaaattggccctttcttttttccgatagatgcgccacctttatgtggtagtagatggatcaagaacaatggaagaccaagatttaaagcctaatagactgacgtgtactttaaaggtaaaatttaagtttatactaaatcatttaaatttgtaccaaaatcacttaaacttttactaaaaaagtggggaagaacactggattctaaaggatatttttaaagaatgcaatattttttattttttgccttgtatttttagttaatgctaatgatagctaagtagaagtactgccaggttatttagggaaattttaaaccaacatagctaattatttgtgtttttaatttctatcctcccaccccacatcaggatcttggtttatcagttatcccttttctttcttgaatcttcattctcctttgccttacttaactctgtctcctcagattacaaatatgttcgtattcctaatttatcaaaacctattctcaattctgctcgttctcccatctctcttcattggatcttttcctcattgaaatttcttctgacacatccaaatggttccatcttttaaaacctagctcaaacctatctcatcacccaccatttcaaattaacgtttttactgtttaatatttttattacttaacagtttttgaaaatctgtaagtttaaaagtcatgagaagtgacgcttgattaacaggtttcacaaacatcagttggacatgttctttatgattgttattttgcctttatctagtatgtctttttttgtttaaacagttgttggaatactttgtagaggaatattttgatcaaaatcctattagtcaggtacgtatctaagtgatagaattcagaattagattcctattttgcttccaaatgtaatttatttttaaaaattggacatgtattttgtgaattacccaaattgtttaaccagtttctggtatacttaaaaatgaaaagcgtaataactctaaaagttaaacgtaatgtgaactcatagctaaatttatttgccaaaaacagcatgagaaaaagtttctcacctgttgcttctttcttttgtaattactagtttattttagctatataaattatttttttttctgctccaatatcatctacaggaatagttatatatattcttaatgggaggaaataacttgttatattaataataatttttgtttttatttcaagattggaataattgtaactaagagtaaaagagctgaaaaattgactgaactttcaggtatgcataaaattacctttacatgactcaaggactttgctttatttacccaacctcgtagccctgtttatatggctgcttaataagtaacgtgaagggtggttcctctgtcttctctaggtgaaacaatttaataacatctcccccaccattatattcttaggatacaaggttaactattctaaattgagttctgcatagtggtaaataatactacattgaatataaatgtttttatttaaattctatatgtgcttatcctgaaatttttttttctttccttttttttttttttttttttttttggagatggagtcttgctctgtcgccaggctagagtgcagtggcacaatttcggatcactgcaaagtccgcctcacgggttcaagcgattccctgcctcagcctcctgagtagctggaactacagatgcccgccaccacgccctgctaattttttgtattttagtagatacggggtttcaccatgttggccagtatggtctcaatctcttgaccttgtgatcagcccgcctcagcctctcaaagtgctgggattacaggcttgagccaccgcatccggccttatcctgaaaatattaaaatacagttattgtaatcatttataaaatccagttaatcttaaaattaaattcttaaaaagttaagcatctaatttaaaagggaaaaagtataaaaattaaactgtagctattgctaatgaatcaatttttctgcttccatgacatacctaactgaattttagtttcaaaacgtagtaatggcattttttatttgctttggtatatatgctgttacaaatttgcatcactgattctattttattttctgtgaaatacactctcccttaaatctggttttcaaccttttatccttgccggcacacataagggaaatgacatactttcttcattagtagtttttcattaaatgcagtgaggagtgaaatgtacattggcctggagtgattcaagaaactcagttgtgagtaaccaaaagaatgtcacactagcttaagtgcagaaggaaaattttgggctatgttcaaaggtgggccaattccatatatagttgctgcatatgttggggtcctggctttgtctggcttcattctctgatagattttctggaagttgaaaagatgtctcttaattgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattgcttctttttttttttttttgagaaggagtctctcactctgtcgcccaggcggtgctgtcttggctcactgcaacctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaagatgaaaaatattctggagattctgacaggcctcttgaagccacctttttttccctccaatcagaccactgctgtaaaccacactgacactattgtagtatgcttttttcctatacccataacacagtgggagattaaaaataattttgtagggtaggaagagaagtggatagagagccaggagatctaggtttgggtgctgctggtcctgcagttaagcaggcatatgtctttgggcaagtcatttcacttgtttagattaattttctcacttatgaagtgagggatttggactgcttagcgaggtacttttcatctctaaaatttatgaatctaaaatacttgcagtaaatattaaatattacaaatggttaatattttaaaacttactcagatgagtaaaaactcaagggagctccaagttgatgaatagacaaagaagacatgattcacacagaaaaaacccagaaattaaatcagggaaactagtaatccaaaaacactctacccaattacataacattttattttttaatatattttaaatgagcaaaattaagtttccaaagcaatatgttgcttgtggaaccacagagaaactgttatttatagtgctgatagtcttacaaattagttcaatattttttagaaaagcataaaaattgttcctgaaattatatttagggaatgttatggaaggagaatgatcactctacaaagatactctttgtaacattatgtataatagtgacagattaaaaattaaatgtttaatagtatgctttgatggattatattttatgacaaaatcaatttaatgatacttaggttattgattgatacgaagacagtgctgaaatggaaaatgtttacggaatactatatttcattgaaactcagattccatcaattacaagatacttttataagccattaagaaggaaaagtcctagtagttaaactttgacacagtatcaaatgatatatgagttggctatactagcttcttggtaatttgacatgtacagacatctcaaatttgggggccaggtgtggtgacttacacctgtactcccagcactttgagaggctgaggcgggaggattgcttgaatccaggagttcaggactagcctggacaacatggtgaaaccctgtctctaccaaaaatatacaaaaaaatttagccaagtgtggtgctgggcacttgtagtcccagctacttgggaggttgaggtgggaggatggtttgagcctgggaggtggaagttgcattgagccaaaattgccccattgcactccagcctggcaacagatatatatataatctaaatataaataatataaaaaaatattatattaaaaagaaaaaaaaggatttggcagcttctccccccttcatttgaattgcttagcataagatagacaatcttttcagatgctatttggtaagataacacagcttcgtctgtttgtgggaatattcgtttcttaggtcttgtaaagttcttgatttcttccctcaagaaaaatacggaattgcatgcattcttccatcaatatttgattcattataataaatttatgcctcactgctgtgttccacacctttctacataaaaatatagccttttgtattaacaacatttctaaaaacattttattgtttgttttttgagatggagtttcgctgttgttgcccaggctggagtgcggtggtgcaatctcagctcactgcaacctccaccttctgggtttaagtgattcttgtgcctcagcctccctagtggctgggattacaggtgtatgccaccatacccagctaatttttgcatttttactacagatgggatttacaccatgttgaccaggtgtgtcttaaactcctgacctcaggttatctgcctgccgtggtctcccagagtgctgggattacaggcgtgagccaccgcgcctggccttaaaaacattttaaatggcagttaaactcaccatgaagaggacaatgtacataatgcaattgaagcaacaacatatgaagacctatttgtaggttcacatatgaacaggcaaagactatgttacaagtgctgctggctaccagtaattattaaacacatgctgatttcagagatgttaaatgtgaaaatgtattggtcttaaaaatgatgaaatatggaaatattaagagtaaaaaaatgcactctaggttagcattattttaaaatatgtatgctagtctataaggagattatttgtattctgtttttcagtatgaagtgagagtgtttacaaaatattgcagataaaattccaacagaaatatacattgaaaggattctgttctttaacatcatagatatgtaaattttgagagaaacataaacttttttaatatataggattttatttaaagatcttatttctattttaggaaacccaagaaaacatataacgtctttgaaggaagctgtggatatgacctgccatggagagccatctctttataattccctaagcatggctatgcagactctaaagttagtattatacattatgtataattgaattagaagttttttaaatgagttaagttgaagtgatgtgttaatatggggcccataaacccagctataacaaaattgttaagtacgagaattatgtagtgttatttatgatgtttagtgtggtgttggttagtaatctttattttacattttagtaagatattgttaaaggttttataaaaatataatttaaaactgtcggcagtatcaatagtacaaaaatatgttgatgaaaaaatattttattaaaatgagatttaatatagtataataattgtaagttggttgtacctttattaacatttattaatttattttgaaagtaatggccaaaaccacagttccttttgcaccaatgtcatatatctgtaaattaatagatatggcaagttcagctatatggaatagagctaagaccccaaaggaaatacttggtatagttaaagcttatatatatatataagctttatatacatattatatatataatttattatacatatatatataaagcttatatatatgttaaacttacatatataagttaaagcttatatatctattatatatacacacacacacacacacacacacacacacacacacacacacgtatatatatattttttttcgagacagagtcttgctctgtcacccaggctggcatgcagtggcgtgatctcagctcactacaacctccacctctgggttcaagtgattcttgtgcctcagcctccctagtgctgggattacaggtgtgtgccaccatgcccagccaatttttgtatttttagtacagatggggtttcatcatgttagccaggctggtcttgaactcctggcctcaagcgatccgcccacctcagcctccctaaagcttatatattttatctctggatagtctgccctggctcagacttatacctttatataatagatatttttctagttttgaagtggatgagaaggaggcaacacatgtaatagaggtaagtacagtagtagggtctaccagtgagagctgagacgataacaatgaaaatataagcaggaaagctataactaattgataaaattgctgcagaaagcataaaaacgtctatttagtgtaggtgaaaactggtcaccacaacttaaaactctacaagctatcattttaattaaatggtatgcaatattaatgttcatgattattatgactctgaattactgtgaggttaaattatagtaatccccccttatctgcagtttcactttccagttttagttactcttggtctgaaaatattaaattgaaaacttcagtaataaataattcataagatttaagttgtgtgccattctgggtagcgtgatgagatcctacaccttccctctctgtcctgcccaggacgtgaatcatcccttggtcctgtagatcctcacagtatatgctgcccacccatgtaatggcctaagtcatcagattaactgttgttattgactgtcaaaactattgcagtgtttgtgttattttacttaataatgacctcaaagtgcaggagtagtgatgccggcacgttgttataaatgttccattattagttattgttgttaatctcttattgtgcctaatttatacattattgatcataggtgtgtatgtaaggcacacctcattttgttgcacttttattgcacttttcagataacttttttttttacaaactgacagtttatggcaactctgttgagcaagtctgttggtgccatttttttttaacagcatgtgctcacttcttgcctctatatcacactttggtagttcttgcaatatttcaagctttgtaaattattgttatatctgttatggtgatctgtgatcagtgatctttgatgttactattgtaattattttagggcaccacaaactgcgcccatataagacaacagacttaattgataagtgttacgtgtgttctgactgctccaccaactggctgttttccagtctctctccctctgttcggcccccccatctcctaagacacaaaaatattcaagttacaccaataataaccctccagtggcctctgagtgttcaagagtaaggaggagtcgcatgtctcactttaaatcaaaagctagaaatgattgagcttagtgaggaaggcatgtcaaaatgcaagactggctgaaggctaggtctcttgtgctaaacacttagtcacattgtgaatgcaaaggtaaagttcttgaaggaaattgaaagtgctgggctgtgcgtggtggctcttacctgtaactgcaacactttgggaggctaagatgggaggatcacctgaggccatgagtttgagaccagtcctggtaacatagcaagacctccatctctacaaaaaaaaaaaaaaaaaaaaaaaattagccaggcacagtggcgagcacctgtatgtagtccctaacttctcaggaggctgaggcaggaggattgagcccagtagtttgaggctgcagtgagctacgattgtgctactgtactccagcttgtatgatagagcaagatcctgtctcaaaataagaaaaaaataatggaaattcaaagtgctgcttcagtggacacatgaatgataagaaagtgaaacagctttattgctgatacagacaaagttttaatggtctagatagaagattaaagtagccacaacagtccattaagtcaaatcctaatccaaagcaaggctctaattctcttcaattctatgaaggctgagagcagtgaggaagctgcagaagaaaagtttgaagctaacagagctgagctcatgaggttaatgaaagaagccatctccaaaacataaaagtgtaagaggggctgggcgcggtggctcacgcctgtcatcccagcactttgggaggccaaggtgggcagatcatgaggtcaggagttcaagaccagtctggccaacatagtgaaaccctgtctctactaaaaatacaaaaaattagccaggtgtggtggtgtgcgcctataatcccagctactcgggaggctgaggcaggagaatcgcatgaacccaggaggcagaggttgcagtgagccgagatcgcgccattgcactttagcccagacgacactgtgagactccgtctcaaaataaaaaaaaaaaaagtgcaagaggaagcagcaagtgctgatgtagaagctgcagcaagttatccagaagatctagctaaaataattgatgaaggtgactacactaaatatcaaattttctttttcttttttgtttttgagagagggtctcgctctgtcacccaggttagagtgcagtggtgcaatcatggatcactgcagcctcaaactcccaggctcaagctattctcccagccccacaagtagcagggactacaggcatgtgccaccacacccagctaatttttgttgttgttgttgttgtagaggtagggtttcgccacattgcccagctggtcttgaactcctgggctcaagcagtcctccgcctctgcctcccaaagtgctgggattacaagcatgagccactgcacctggcctcatattttcaatgtaaatgaaacagccttctgttggaaggagatgccatctaggattttcatagctagaagaagtgaatgcctggtttcagagcttcatgggataggcttcttctcttgttaggggctaatacagctggtgacttgatgttggcaccaatgtttgttaccattctgaaaatcctagagtccttaagaattattctaaatctattcagtctgtgctctgcaaatggaataacaaagcccagataacagcacatctgtttacagcatgggcttactgaatattttaagcccattgttgagatatatctcagaaaaaagatttatttcaaaatattattgctcattgacaatgcacccagtcacccaagagctctaattgagatgtacaagaagattaatgttattttcatatctactaacatagcactcattctgcaacccttggataaaggaatactttgaactttcacgtcttgattatttaagaaatacatatcataaggctgtgactgccatagatggatctgagcaaagtacattgaaaaccttctggaaagaattcaccattctaaatgccattcatagaaagaggtcaaaatatctacactggctgggcatggtggctcatgcctgtaatcccagcacattgggaggccgaggcggatggatcacttgaggtcaggagttcaagactagtctggccaacatggtgaaacccgtcctcactaaaaatacaaaaattatctgggcatggtggtgcatgcctgtaatcccagctactggggaggctaaggcaggagaattgcttgaacccaggaggcagaggttgcagtgagccgagatcgcaccactgcactccagcctgggtgtcagagcaagaatcagtctcaaaacaaaaaaagaatagcccataaacttagttggtaaagcatcagtggggtttcaaaggaatgactcccattttgaaagaggtactactatgaataaaatgctaccaaacagcatttgcattcctttcatgaaaggaagagttgacccatgtaacaaactactttgtcttattttaagaaattgccatagccacctcacccttcagaaagcaccactctgatcagtcagcagccatcaatatcaaggcaagactctccttcaacaaaaagatattattcactgacagttcagtcgatttttagcaataaagtatttttcataaaggtgtgtacttttttttttagatataatgctgttgcacacttactagactacagtatagtgtaaacagaacttttctttttctttcttttttttttttttgagacggagtctcgctctgtcgcccaggctggagtgcagtggcgcaatcttggctcactgtaagctccgcctcctgggttcacaccattctcctgccaccacgtccggctcatttttttgtatttttagtagagacggggtttcaccgtgttagccaggatggtctcgatctcctgacctcgtgatgtgcccgcttcagcctcccaaagtgctgggaatacaggcgtgagtcaccatccctggccgtaaacagaacttttatatacactaggaaacctgaaagttcatgtgacttgctttattgcaaatatttattgtgatatttgctttattgctgcggtctggaatccaaccctgcagtatctccaaggtatgcctgtatagggaaaaacatggtataatcagccctctgaatcctgggttctgcttctgtgaattcgatcaaccacgcatcaaaaatttttggaaaaaaattgtacctgtactgaacaaatagacattttttcttgccattatcccctaaataatagaggataacaattacttacatagtatacattgtattaggtattatcaataatctagagatgacttaaaatatatgggaggatgtacataggttatatgcaaatactacgcccttttgtatctgggacttgaacatctgcagattttggtatccataggagggcctgaaatcaatcccccaaggataccgaagaacgactgtatatatagggttcagtactatccttgatttcaggtatccactgggggtcttggaatgtatcctctgcagataagaggggactactatagtctttgagaaagaagtgtgtgttactgttttgaagccacatctctgcactttaaagctgatccatatgatattgccacattttagtttaaagtttatccatatattgttgtattttttattgtatactctagactttgtatgaaacaaacctactagaatgtaagcttaatgatgtcgggaacattgtcagtcttgtttatcactctacccccagaacttgagagtacttggtaaatattaaatgaatcaattaacaattttttgaagtgcatagctcattttagaaaaatttgcattaaagtgtttaaaatatactcacaacctttctttgcattgttgaaacaaatgagatattctatagtctaaatgtgtaatcctatgtttactgttctttctgggtaaattttttggtagtataatttgttgtacctaattggagtgtattttatctttcttttaagacacatgcctggacatacaagtcgagaagtactaatcatctttagcagccttacaacttgcgatccatctaatatttatgatctaatcaaggtagaccaaaaaatcaaaaccaaagttataactgtaaagagaattctgtagcaaattgatttatatatatatgtatttttgtatgtgtgattcatctttgtggtagatgtattgaatttattactagttttcagagcattctttatttttcaaatacattaaatcttaaatgtttttcttctttcctaaaactatctatctacttggattttatgaagaccctaaaggcagctaaaattagagtatctgttattggattgtctgcagaagttcgcgtttgcactgtacttgctcgtgaaactggtggtatatatataatttatttaatatttgcttataattactgtgtaggaaataatttattaattaaattaggatgttttaatctgttctgagctactaaacttaaagtagtctaaaatatgggcagtcatcttaaatatatcattgattccataagaaatcatctccaaatgcaaagagttttcagtacttatgtcagtatttagaggaggtattataactcttggaaagctggaaattttactgtatgtaattctttataaagattttataacttgtctttaattaaattgtaattacaggccaggcatgatagctcatgcctgtaatctcaacattttggtaggccaaggcaggagaatcacttgaggccagaagtttgagatcagtctggttaacatagtgagacctgtctctatttatatgttaaaataataatagtagtaataataatcaattgtaattatagttattcctagagaagttgatttagatatattacttaaataaggttttaaaagtgataatttagctaaaatcattattttaaaaatgtacattttcagatgatacaacttttacagaattacatagaacgtacagttcgttatgtctatgaaggtgtttttttttcccttttcatcttgttaggcacgtaccatgttattttagatgaaagccattacaaagagttgctcacacatcatgttagtcctcctcctgctagctcaagttctgaatgctcacttattcgtatgggtaagtgtttttatgtttttaaaaaatacatatctaggctctctattttcatttgcacaagttattttaatatttaagaatttttaaagaaaaaatatgcttgttgaagcaattttggaaagtacagagaagtggaaaaaaaaaattaaaactaccagtagtcctgtcacccagaaaatactgttggctttctttatttttaaggctagaaaggtataaactgtgtttatagaaaaatacttatattaagccgggctcggtggctcacgcctgtaatcccagcactttgggaggccgaggtgggcggatcttgaggtcaggagatcgagaccatcctggctaacacggtgaaaccccatctctactaaaaatacaaaaaattagccaggcgtggtggcgggcgcctgtaatcccagctcctcgggaggctgaggcaggagaatggcatgaacccgggaggcagagctggcaatgagccgagatcacaccactgcactctagcctgggcgacagagcgagactctgtctcaaaaaagaaaacaaaagaaaaacacttatattaaaaattttttaaaataagctacaaaggccgggcgtggtggctcatgcctgtaatcctagcactttgggaggccgaggctagcggatcacctgaggtcaggagtttgagaccaccctagccaacatggcgaaaccctgtctctactaaaaattaccaaaaaatggctgggcatggtggcagacatctgtaatcccagctactcaggaggttgagacaggagaattgcctgaactcaggaagcggaggttgccatgagctgagattgcgccactgcactccagtctgggtgacagagcaagactctgtctcaaaaaaataaaataaaataaaaataaaataagctacaaaattctctgtactggatgatcaaagctgtgtaatgcaaactgtgcaaagacaaagcttgcagggaagtacaccaaattgctcaaaggaggggaaattattggttttggatcacttttttttttctttttttttttgagatggagtctcattctatttcctaggctggaagtgcagtggtgcgatctcagctcacactgcaacctccgcttcccaggttcaagcaattctcctgcctcagcctcccgagtagctgggattacaggcgggcaccaccatgcccagctaatttttgtatttttagtagagacagggtttcaccatgttggccaggcttgtcttgaacttctgacctcatgatccgcccgcctcggcctcccagagtgctgggattacaggcttgagccactgtgcccggccttggatcacttttttaaaatgttattttcttctattttacaaaaatgttacaatgaaaatttattacatttatattgaaaaaagtataacttttaatagaaaaataatctccttatttaatatgtatgtttttaaatgttaatgaaataaaatgcttttctacttttggccttttatattaccagtcgacctctcttttccacggtcttctcatgtgtttaatgatgtcagtaactatcaaccttattgtgtgtttcaaggattgagttaatacagatgatgcgtttagaataatgcttgatgtaaacattcaatacattttagatcttatgtttggctaatctttttgatttactgatatattttcttatttcattttaaagttatttaaatttataatttatttattagagtcctttaggaatgttaacccttctcagtcacccgatgcaaatatttttcttgttggttatttgcctttacttttatttatttgttttgatatgtagatacatttacattttttatgtaatatatctttttaaaaatggtttctgcttttcctgaacatgttttcagaatttaaaattgtatatggaaaacaaattacatgaaagatttgagcatttcaaaattttaaacataaaagcataaacgtagataaaatgaaggtgtactatgatatcttcagttttatcagaaatgatgtaaaaattacaacctctttaaaaagtagtgttaatcattaagttagaaaatatatagctgggcatggtggcagatgcctgtaatcccagctacatgggaaggtgaggtgggagaatcgcttgaacccaggcagtggaggatgcagtgagccaagatcatgccactgcaccccagcctgggtgacagaacaagactccatctcaagaaaaaaaaaaaagaaaaatatatatatgaacttcagaatctgaggtcatatatagacaggtctttcccccgtttcctctactttttcttgtagcttggaattagtcagtttcatcatgctataataagcttatctgaaaggcagtaaagtgatattttgtacaacttcattggctttttgagaagaacatttttaggttcttagtcctagaattctgctgtttgcttggaaaaagaaagtaatacattttcttctatgaaggatttcctcagcacaccattgcttctttatctgaccaggatgcaaaaccctctttcagcatggcgtaagtaaagaccttgaaaatatcagtgataatgtttttacatttttaattccttcttttaagttataaattcaaaagataggcaatgaagactatctctatatacttgtatggagtgatcttcaggataaattactaagtaaaacagtagtttgagagaattttgtagtatgctgctaatcacctaagaagaaagtagagatgtaagtggatgtatatacttgtttatgttaataataaaaacaatagtatggaaataataaaaacttaaaaggggtggagggggaaatttttttttttaatgtttacctcagtgagtgtgtagggaaaagcaaagggttagaccctagacttttctgaatgcatcacttaatgatagggatacattccgagaaatgtgtcattaggtgataccatcattgtgcaaacatcacagagtgcacttacacaaacctagatagtgtagcctactaacatcgcagttatatagtatagcctattgctcctaggctgcacacctgtacagcatattgtgtactgaataatgtaggcagttgtaatgtaacacctagtgtttgtttaactaaacacagaaaaggtacaactaaaatgtattattttatgggaccactgtcatatatgtggttcatcactgaccaaaatgttatatagaatattactgtaccttgttttaacttcagagctttgtattttacataattataaaacaaaattaaatttaagagagtaattcttaaaaatcacaaacaagatttctgcctccagccaaaaagctgtaacagggactagatttaccctcctgtcaaaaaaagcagacaaaatatataaaacagtggttttcagacgttggacagcaagccttgctgataatgatccctgaaagaaaggaaacaaatgagatgggccctaagagcactccaccttactgcctggatggaatttccaggctgcacacagaggctggagatgttgttgagttgaagaaacaaagttcatctttcaaggaggctgagatggcgataattttgcaggtcagagtactggagaggaaagatctgcacagagagaactctctggggagctgcatagacttgctcatgagtcagcagctgagcgttgatcagcccttttgtgtgaggagactactggaagtcagggaaaaaatcactggaaagcagcagacagaacagtttccagagctcacacagagaacattcatgttctcaccagtctgtatggaaatacctcttaacatgacaggcattgaatagagtccacagtaatgggatcaaattaattctatcacaagaactggaaccagaggcaaaaagaaaagaaaagaaaaatctagactaacagctgttctagaccagcctaacaaagtttaaaagcaaattttgaagagattaaactatttccaagttaatgaagtatatttcagaacaaacccttaaatatttgagggaatacaaaaaaaaaaaaaaaagaaaaaatccagcacccaaaacaaagcaaaattcacaatgtctggcaaagcaaaattcatagtccctggcagaaattaccagggatgcaaaggaaaatatgacccataaaatggagaaaaatcacagaatggaaacatacccagaaataacccagttggtagaattaatagacaaagggttgggtgcggtagctcctgcctgtaatgctagcactttgggaggctcaggtgggcagatcacttgagcccaggagttcgagatcagcacagccaacatggcgaaacccatctctactaaaaacacaaaaattagccaggcctggtggcacacgcctgtaatcccagctacttgggaggctgaggtacaagaatgacttgaacccaggaggtaaaggttgcagcgagctgagatcgtgccatttcactacagcctgggtgacagagcgagactcttatcaaaaaagaaaaaaaagaattagtagacaaagatgttaggacaacaattataaatgtactctgtatgttcaggatgttagagaacatgagaatggtaagaagagatatggaaggtataaaaaagacccaaatcaaacttctagtgatgaagaatacagtgttttagatgaaaaatatattggctgggattaacagcagattagacactgcagaagaaaaaattagtgaattcaaagatagtaatagagactttaaaaatgaagagaagggctgggtgtagtggctcacatctgtaatcccagcactttgggaggccgaggcaggcagatcacttgagaccaggagtttgagaccagcctggccaacatgatgaaaccccatctctactaaaaatacaaaaattagctgggtgtggtagcacgtgcctgtaatcccagctactcaggaagccaaggcacgagaattgcttgaacctgggaggcggagattgtagtgagttgagattgtgccactgcactccagcttgggcaacagagtgagaagccgtctcaaaaaaaaaaaaaaaaatgaagagggggaaaaaaatgaatgtagcataatttagttataagacatactcacagattttaaaatagacttttagaccaggcatggtggctcacacctataatcccagcactttgggaagctaaggcaggtggatcacttgaggctaggaattcaagaccagcaatatagtgagagacccccatctctatataagttataaatttttttttaaatatagacttcttttgttttttttttgagatggagtttcactcttggcacccgggctggagtgcagtggtgcaatctcagctcactgcaacctctgcctcctgggttcaagcaattctacttcagcctcccaagtagctgggattacaggcgcctggctaatttttgtattttttagtagagatggggcttcaccgtgttggccaggctggtcttgaactcctgacctcaggtgatccacccgccttggcctcccaaagtgctgggattacaggtgtgagcctctgcgcccggccaaaaatacagacttttaaatagatttttaaatagtgtcaagattttaaggtcaagatagcatgctttcccgctctaacttttcagatcattatatattaccctttttccccctacaggcatttggatggcaatactgagccagggcttacattaggaggctatttctgcccacagtgtcgggcaaagtactgtgagctacctgttgaatgtaaaatctgtggtaagaaaacaactattcattattcagtaaatcttgaatgacttcttaatctgtattgctgctaaaattaatgtaaatgttaagttattcctatgtttctggatttaatctgtgcaaagaaaaatagattactttttaaattgagtgcccagtactccacttccatgtataaatgtagcattctagtttcctgatcctctttctgaaaaaagtatattctttaaaggcagtgcagtagatgtagtagacatttttccatctcttacctttataaagtaaatatatataagaatgaagaattaaactaatagaattgtcgaattttatttcatttataatataagtaagcaaatagaccgagacaggttggttacacacttagtgacagaactaagactccatcctacaatcttctgttatagccacaggtaaaattaataactgccatcctaaaagaaactgaacatattctgctgaagttacatcttttggcttttcagccgttgtcttcatgaggtttggactactcaacatgtctctctgcttaatgtgttaggtcttactttggtgtctgctccccacttggcacggtcttaccatcatttgtttcctttggatgcttttcaagaaattcccctagaagaatataatggagaaaggtatttcagtttggactaatttatatctgttataagtggtaagctaatgtttgaatagattgttactaccttaaaaaataatctgattaacttggacaagagtacttctaatatggaagatgagataaagaatgccatagttatgattgaaatgactcgttgctaaatagatctgaatctccagaaaccaaataatttcactaaacccacctatgtataaataggggtgatgattgtactactaaatcagttttccagaaggaaaagaaaaaaagccctgattggtagtatttgctgatttccatggtttgaatactcccaccatggccaatttttagctacaattaacaaccagctttcttgaatacatatttaacaatatatccttttgatccagtacaatccagtcctagcacactactgaaaataagaggctcattcagcactttgggaggctgaggtgggaggatcacttgaggccaggagttgaagactagctggggcaacatagtgagacactgtctcttaaaaaagaaaaaaaaagctggacatggtggctcatacctgtaatcccagcacttttggaggccaaggcaggcagatcacctgaggtcaggagttcaacaccagcctgaatgacatggagaaaccccatctctactaaaaatacaaaattagcctagtgtggtggtgcatacctgtaatcccagctactcgggaggctgaggcaggagaatcgcttgaactcgagaggcagaggttgcggtgagccaagatcgcaccactgcactccagcctgggtaacaagagcgaaacttcgtctcaaaaaaaaaaaaatctggcataacataatttatctaaaatctttaagtatttttacgaatgctatttgtgtgaaatacaacaaataaagtctgaaatagaggtagtcaatcctttatagaatagttttcagaaaataaagatttactacttttaagaacatctaggatcggctggcacggtggctgacgcctgtaatcccagcactttgggagaccgaggcaggtgggtcacctgaggtcagcagttcgagaccagcctggtcaacatggtgaaacaccgtctctactaacaatataaaaattagccgggtgtggtgggaggtgcctgtaatccccagctactcaggaggctgaggcaggagaatcccttgaacctgggaggtggaggttgcagtgagccaagatcacaccattgcactccagctgggcgacaagagcgaaactccatcaaaaaaaaaaagaacatccaggatttaggaatcacattaaacacttactggctagccaaaaacaattatgtatccatcttgcttttcacacttaaatcatttagaagtcattcaatatcaccatatctagatcaatgttgtttttgaaattgttgcatatttcaggtataattatggtttatataatcaattgcttcctgttggatatttaagattttctttttttgctattaacaaataatgcttatatctatatttttgaacatttgtacaagtataaatgcatggtaaattcctagaggtaaaattactgagtcaagagttttacatgttttgtgaattttgatagatattgtaaagttgttcttcaaagaagtttcatttattgttttcccacatttagccaacattaggtattatgaaacttttttatattggccaaaactcacaggcaaaagaaaaagaaaaaagtctcattgttttagcttggtatttatttgcttatggttgaggttaaatgtagtaaaaatgaaaaacccagtactatagaagatagagttgaagaaatattccagaaagtacaataaaaggagtaaaataaagaggttcaaataggagagtaaagataagaatactggtggaattatccagaaggtccaatatgagaatgatacgagaaaaaaagaaaaaaagtaggatagaaaatcatcaaagacatagttcaaagaaattttatattgaaggacagaactttctagattgaaagggcctgttggctgggaagggtggctcatagctctaatccttgcactttgggaggctgagactgggggatcacttgaggccaggagttccaggccagcctgggtcacacagcaagacctcatctctgcaacgaagataaaagaaagggactgccaagtgcctaacgtattgaaggaaggcagaccccataattgtgaaatttcagaatacacaataaaccattaaccctaaacatttccagagaggaaaaactaggtcacacacaaaggatctggaattaaaattgtttggcttctcattagcaacaccggatgcagagagggagcagtcaccttcaaagtttgtggtgaaaattgttaccaacttagatacccagccaaactatcagttaagtgtaggtagaataaagacattttcagacttgtaaggtctcaaaaagagatttttctggggaaggtctggaagaggtaggtgattcaaaggaactgagaaggagaatgacatgggatctagtaatatgtatctaattcaaaacaggctgaagaacggcctaggatgatggtaaggagaaattccagaatgatacctgtgtgtcacatatggggaaccgtccagtttggagacagtcaggatgctccaggagagagatcaccaaggggatgaaaactgcagaactcctgatgtatttgaacatatcgagaggacagttagactattccggagaagattgggcctgaattagtgtcaattatataggaaactaaccttgggaatagcaacacagtatttccaggaaaaaaaaaaatgttttaaataggggaaaacttatggcttagctgagaatatttttataggcatagtaaactaaacattgattattgttctatccaaaaggaagacttcactatgtagaaagaattgagaatgacactagttaaatatttatgcattactgggttcaagatgattgaaagataattaaattctcttctttcatagttggagatttatagccaataactgtgaagaatcacaaagtagcacttattagaataagtgactatcaaacaaacgttagaaagtgcttctggctgggcatggtggctcatgcctgtaatcctaacactttgggaagccaagataggaggattgcttgagcccaggcattcgagaccagcctgggcaatatagcgagaccctgcctcaataaaaaattagccaggcatggagatacatgcctgtagtcccagctactcaggaggctgaggcaggaggatcacttgagcccaggaggttgaggctgcagtgagctgtgatagcacctcagcactccagcctttgagacaaagcaagaccctgactcgaaaacaaagaaaaataaagcatgctcacagttaaccttaatgaaaataaaaactaaattttgggctgtcagatgaccttgtatatactgtggaatttttttttaaattattgctattctttttttttttttttttttttttgtgagtcagagttttgctcccgttgctcagtgtggagtgcaatgacaccatctcggctcactgcaacctccgtgtcctgggttcaagcgattctcctgcgtcagcctcctgagtagctgggattataggcgcctgccatcacgcccagctaatttttgtatttttagtagagacggggtttcgccatgttggccaggctggtcacgaactcctgacctgaggtgatccacccgcctcggcctcccaaagtgctgggattataggcgtgagccactgtgcctggcctattggtattcttaactctttttcctgaaagtcatgtgtaaagacaagtacatattaattaaaggattctagttagtgagattttgttgaactattttaatgagtaaattctaagaaaaaacattgttaaacttttttttcagattttgttatggatgtcagggggaattgaaagaccaacatgtaagttctttggctttctaaatattaagtaatgtacaagaaatattgaaatcaatggtactataagttttcaacaggttgttaaagaccaggctcatatcagtttatttcttgtaaagataatgacaataggtgaaggtaaaataggaacaaaatagtttaaatagtagttttgttattctgcattctaatttttgctataaagtattttgtaattcatctttttaaaactttttattaaaaattttttaatttttttcctctttttttaaattctttgattgttttgtctactttggtacacccttgtaaaacatgtaatttgtctttagctttcaagctaaactgcatttagtctgaaagtatttaaaatattttcttcatattatactttaagctgtgtgataacacattgaaattgtttaaggtggccacagataataggtgattcttccattatgccaatgagaaaatacttttttaaattttgaagagggccaactttaataaataaatttgtatagatgtaaataatatggatcactgtctagctttaatttttaatttagttacatgttcatatttaaaactatatatattatataaaataataattagaagtattgctcttccactgtcacaatttataaagtaattttattaaattttatatacctctttgacatcagtagtttactcttaactggaaccactttttgaatcatttgacagttttttggttttattttctgagacagactcttgctctgtcacccaggttgtagtgcagtgatgcaatcttggctcactgcaacctctgcctcccaagttcaagtgattctcatgcctagcctcccaagcagctgggattataggcgtgcaccaccatgcccagccaatttttgtatttttagtagagactgggtttcaccatgttgaccagctggtcttgaactcctgggctcaagcaatccacccgccttggcctcccaaagtgctgggattacaggcgtgagtcactacacccggcctcatttgagtttttaagaataggtcattgtctgtgttgtttgaaatttatttattcattctttttttttttttttattcaaagccaaatacttctgagatttagtgatttttgaatctgtgtatgaagctgccctggaaattttatcccaaggagcaagtactcatatatgtaatgctgaaagaacaaatgtagttttttcctttctgcttgtcttatctgtgtcatttgacatatttttttaaaggtttacttgaaagggaaatatgtttgcaattgtgaggtcattccctaagaataattaaatcgatgttaaatttttatgcttctctttttaattgaatcaatcaggtggtcttgctaagcattcaaaagtagcgctggtttgaagctcatatgtctttcctaaaccttagaatgaaataattgagagcgaactgtaatagaatagactttaaagactcaaaaacaaaaccattccctcatttctaagggatagttttggggaaaaaattaattgccttagatttgagaatatagagtacattggaagtaataaagtaggtagtgggaaaaaattggtagagatataaaagagcaaagcacaccttgaatgtcatctagctgtgctgtaattaacttttggaaactagtttatcacttttcttcttttcactacaggtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtctctactaaacatacaaaaaattagctgggcctggtggcgggcgcctgtagtcccagctattcggaaggctggggcaggagaatggtgtgaacccaggaggcggagcttgcagtgaaccgagatcgctccactgcactccagcctgggcgacagagctagactctgtctcaagaaaaaaaaaaaaaaaaaagagtaaatcaggctttcatagcaaaggtatgtctattttatgtatataaacttcaggtactctaacttgagtttcactatgaaatttgtgattttttttttttttttttgagatggagtcttgctccatcgcccaggctggagtgcagtggcctgctgttggctcactgcaacctccgcctcccaggctcaagccattctcctgtctcagcctcctgagtagctgggactacaggcgcctgcc

SEQ ID NO: 14436 - DNA, 32068 bp, Human; identical to SEQ ID NO: 12970

SEQ ID NO: 14437 - DNA, 32068 bp, Human; identical to SEQ ID NO: 12970

SEQ ID NO: 14438 - DNA, 32068 bp, Human; identical to SEQ ID NO: 12970

SEQ ID NO: 14439 - DNA, 32068 bp, Human; identical to SEQ ID NO: 12970

SEQ ID NO: 14440 - DNA, 32068 bp, Human; identical to SEQ ID NO: 12970

SEQ ID NO: 14441 - DNA, 32068 bp, Human; identical to SEQ ID NO: 12970

SEQ ID NO: 14442 - DNA, 6033 bp, Human
  misc_feature (1)...(6033): n = A,T,C or G
ttagaggaattcctaagttctcactactttcacatattattttatctactgtggaatgataactttgttaacatgaagcttttcaagctgtcactgtattccatcgggtatttcggttggttcatcaaagtgaaatgaaatgaaaatgcaggaaaaacaaatgaatagaacacaattaagagtaattcattttggccaggtccggtggctcatgcctgtactaccagcagtttgggagctcaggagttagagaccagcctggccaacctggtgaaaccccgtctctactaaaaatacaaaatgtagccaggcgtcatggtgcacgccttctggtactggaaggctgaggcaggagaatcacttgaacctgggaggtggaggttgcagtgagccgagatcatgccactgcactccagcctgggcgacagagcgagattccctctcagaaaaaaaagactaattcattgaaacaccagtttgtaaagcatcagggatgcttttctcttgttaactacaacattgttgttgaaaactctgctaaaatttcacattctttttttaaaaaggtaaatgaattttaataacgtattatgcataaaaattatttaaagttgacattaatataaaacttattgagctactttaaagtttttttcacttcctttttaaacttttattttaggttcgggggtacaagtgcaggtttgttacataggtaaacttttgtcatgggggtttgtggtacagattatttcatcatccacgtattgagcctagcacccattagttattttccctgatgatctcccatctctctgcctcctctctctgaaagtccccagtgtgtgtcgttcccgtctgtgtgtccatgtgagttctcatcatttagctcccacttacaagtgagaacatgtggtgtttttctcttcctatgttagtttgctaaggataatagcctccagctccatccatgtccctgcaaaagacatggtctctgttcttttttatggctgcatagtattccatggcatatatgtaccacattttcttgatccagtgtgtcactgattgccattttggttggttccatgtctttgctattgtgaattgtgctgcagtgtacatatgcatgcatgtgtctttataacagaatgatttatattcctttaagtatatacccagtaatgggattgcagggtccaatgctatttctgtctttaggcttttgaggaattgccacactgtcttccacaatggatgaactaacttacactcccactaacagtgtataagcattcctttttcttcacaacttcaccagcatctgttattttttgactttttagtaatagccattctggttggtgtaagatggtatctcattgtagtcttgatttgtatttctctaattatcatgaacagacagttttgaaatttttacaatcttatgaagacaaatgaatacagaattttctgagctggggtacaaatggcttttctggggcaagattatagagattaacaaaatgagatggggagaaattgagccacattattgtcaaatttagcttgctgggagtaaaaaacaaaaaaccaacaaaactgaagtcttgcacttattagtaactatttctggcttccttccctctgctaaacatggattgtcagatttctctctgtgagttgtcctcatccactactagagtcagtcaatggccctacactgtattccctggcaatgattttgcaaggagtttcgttcaggttcttaacactttaagataatgtcaacattcttccttaacttctctctgcttccaatgtcttccatttctaatccgccctgcacacagaacattttatttatccttcttaaatacagaaactactctcaattgtctacaggataaagcaccaaccttttaaactttaccaaactaacttggaaaagtaatttcctgggagaagcggcgtcggcggctggagcagaggcagcagccggaggagcagcagaggcggtcgggagcgatgaagatggcggcggggggcggcagaggcggcggtggcggctactaaggcggcggcagtgagggcggcggtgcccctaagctgctcaagactggcaacgccggcgaccagcacggaggcggcggcggcggcggtggcggtggaggaggcggggcggcgggggcggcggcggggagaactaccatgacctgcacaaaacccctgcctccccagttgtccacagcaggggcctgattgacgatgtggtggaagctgaccttgtggaggccttgcaggagtttggacccatcagctatgcggtggtaatgcctaaaaagagacaagcactggtggagtttgaagatgtgttgggggcttgcaacgccgtgagctacgcagccgacaaccaaatatacattgccggtcacccagcttttgtcaactactctaccagccagaagatctccctccccggggactcggatgactcccggagcgtgaacagtgtgcttctctttaccatcctgaaccccatttattcgatcaccacggatgttctttacactatctgtaatccttgtggccctgtccagagaattatcattttcaggaagaatggagttcaggcgatggtggaatttgactctgttcaaagtgcccagcgggccaaggcctctctcaatggggctggtatctattctggctgttgcactctgaagatggaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggccacgggcccccccgacctcactacgaagggagaaggatgggtccaccagtcgggggtcactgtcggggcccaagtcgctacggccccccagtatgggcaccccccaccccctcccccaccacccgagtatggccctcacgccgacagccctgtgctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtatttctctttcctttatgccattttttggtttttgtttttgttatttgcaaaagatcttgtattccttttttttttttttttttttttaatgctaggttcgtagaggcttaaccttaacggaaacgctggaagtctgcagggggagggagaggggaactgatatctcccaagattaaccttcactttaaaaaaattattgtacatgtgatttttttttcctgttcatacatttgtgctgcccatctactcctggcacatttcaataaaattgtttggaaaataaacacagcacttgctgggaaaaaaagaaaagaaaagaaaaacaatttccaatatttgttgtctcaaagatactagaatatactgatttatagctacttattttttccaaacaaattagtccactatgaataacctccacagtctctttttgttgttgttgttatctatctgaattctgcccatttaaggtaaactgatgtctataattactcctgctcaagaacttctagagccttctaacatctggtaaccaattccgtctttaaagtacctactaccatgatttcagttttcttgactgtatcctaacagaaaaaaatagtacaaaggggtcacaaatgcagaagaaaagctggaaagatagaatgattaatattcacaaattttagagtaatagatggatagttttattgtaattggaagtgtggaggatttctgtgaattggtatactttttttttatactttaagttctagggtacatgtgcacaacgtgcaggtttgttacatatgtatacatgtgccatgttggtgtgctgcacccgttaacttgtcatttgcattaggtatgtctcctaatgctatccctcccccctcccccgaccccacaacaggccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctataaaggacatgaactcatccttttttatggctgcatagtattccatggtgtatatgtgccacattttcttcttttttttttttacctaatttcacaatttattataaaacgaccataaaagcctgatgggattttgatttgtattgtgtatatatcaatttcaggagaaatgataccttacaatccagcaatatgttctatacctgcatttatctatatctttttttatatatatatattttttattatactttaagttccagggtacctgtgcacaacatgcaggtttgttacatatgtatacatgtgccatgttggtgtgctgcacccattaactcatcatttacattaggtatatctcctaatgctatccctcccccctccccccaccccacaacaggtgccggtgtgtgatgttccccttcctgtgtccaagtgttctcattgttccattcccacctatgagtgagaacatgtggtgtttggtttttgtccttgagaaagtttgcgaagaatgatggttttcagcttcatccatgtccctacaaaggacatgaactcatcattttttatggctgcatagtattccatgatgtatatgtgccacattttcttaatccagtctatcatttatggatatttgcgtggtttcaaattttttactatttggaaaaagggcacaataaacaaatatgtgcatgtgtttttatagcaccatgattaataaacctttgcataaatacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14443 - DNA, 29936 bp, Human
ggggcgctgaccctcatcccaggggtcaggcagaaggggccgatgggatgggtcaggtgctgcagagatgttcagtgggctggagacagaggggtcttggcatggagaacctaggagggatagtggcctgggcagtgcatctcagaggagcagtgagcttagagggcacatggtggtcgcttcagcaatggatgagtggtggagacagtaagtatataaattcttaagtgaagtttctggggcagaaaaggagggaaaatgaggccattagaagagtgtgggggccaggtgcagtggctcatgcctgtaatcccagcactttgggaggctgaggtgggtggatcacgaggtcaggagatcgagaccatcctggctaacacggtgaaaccccgtctctactaaaaatacaaaaaattagccgggcgtggtggcaggcacctgtagtcccagctactcaggaggctgaggcaggagaatggcctggatgcgggaggcagagcttgcagtgagcctagatcgcaccactgcactccagcctgggggacagagcaagactccgtctcaaaaaaaaaaaaaaaaaaaaaaaaaaaaaaaaaaaaagaagagtgtggggagtcaccttctctgcaagaagcttcctgggcctcccaaataaatccatccctcccctccccctccccctctcccattccatacattttggtgccattcactatataattcccagcagctgctttcatatctggggcatactcacaggggtcagtcaggagggcactgtcctaggactgggagcgggaggatgtgggggtctcccctttgagtttctgctatgatgtgattccaattgatgggccaacacacctctgataccttgtgttatgctgtgtactgcctcaaagtgaataatagcttgggatttagtttgtgtagtctaaggaaaatactttgtgttgaactagtcaggctgttttattgatggccattaaaaggccttgtgcttaggtcttacaagcttttcaaaggcccaaagaaatgattcagacaaaaaaaaaaattagactccaaaatactaaaagaaaactgcaaaaacaggtgaattaatggtgaaagatctgtaggacatagcagtaaggctaccacaacccagctttttgaggttgtcttaaattaatgtgatatggggtgtaggtatgttaacatgcttgataatggaagagtgaggatacctgcttcttaaacagggcctgctcatttttttctggcctctagtacatttctttctggcaaaactcaagctctgttttcacggagatgatgcactgagccatggcatccctaggtggtttgattcatttctgcaccccggtgtctagcaaagtgccacgtgcatgtgtttaatcaaaatagcttgtggttgtcaagctctttgtattcttccctccctccctgtgatttgatttcctgaaagtatcctttccccaaggattatggaacatacacttgttaaacactggacccattttcatgatcatttaaatgtcatgacctttctgacaccttgatatggtttggctctgtgtccccacccaaatctcatctaaattataatccccatgtgtccagggagggatctggtgggaggtgattagatcatgggggcagtttttcctatgctgttctcatgatagtgagtgaattctcatgagatctgatggtttaaaagtgtttggcacttccccccttgctctctctcctgctgtcatgtaagacgtgcctacttccacttccaccatgattgtaagtttcctgaggcttccccagccatgcggagctgtaagtcaattaaatcctctttcctttataaattacccagtctcagatatttctttatagcagcgtgaaaatagactaatacatgcctcttgagatcctcacagcaattggtgcctttagacctcttcattcacacttcactcatgtgttcttccttccccaggtagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatggtgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccattcaactgccagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaaggcttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctcctacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttcatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtagaaaaaccaattcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacatatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatagaatgttgcgcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgttctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattggaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatctatattactattttcttcttacttctgttatattaattatgttttttattttctgtatcttaccatattttgacattctggaagatgtttcatatctagggagagactgctccaccaggggctaagcagttcctaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatgttggccaggctggtctcaaactcctgacctcaggtgactcacccgcctcagccttgcaaagtgctgggattacaggcatgagccaccacgcctggccgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgtttattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatttgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaatgaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcttgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcagtaagtgatgcagctggacttgaatatgcttctcagactccccagataatgatcttatcacaaggctgtaaagcttttatatgtaatgtgaattgatgtatttaataatcaatgtgtttcttcgtagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatgaaacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaacttactatatgtaaggaacttttccagtcactttctaaaaatataacatttgctaaggtgaaaaaaatggagctcctttggcggtagattggggaaagttattggttattggttttcaatgcttctctctccctttatctaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacgacctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattgttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgtttttttttttttttttttttttgagatggagtctcgctctgtcacccaggctggagtgcagtggtgcgatctctgctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggctccttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggcgcatggagttatggacatgtacaattaaattaagtcaattgattcatttagttaaattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccacagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgggtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttgatgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttctcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgacccgggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttatcctgagaatctgttctttgtccagtccacagcttacctgcacatttgcacattcccaggcctcaacaaggtgaggagaccttctgcagagagttcttcctgttgtggggaagcaggtggggaggagctggaggaggggaggggagtggaggtcagaggctattggcttaacagtgagccctaactcccttcttctagctaaactctactccctctgctcatttgcttctaaaatggattaaaatgtgagccttgtcaataactgtttattaacttcttatcaatttactattaacttatcactttacctgtccaaaaaatgataaagggaatatttgtatagacttttacattttacaaagcgcttttattttttcctttgacccagaaggtgggcaaaattggtgaacttgctgtccaaaatgcatgctctaaagcttgttaactctgatggtcagagatgacacccagtcagtgcctccttcttacctcacagcaatgctaaggggcaggtgactctctcagtacctggggagaaggggcaggtggcaggttggcttagagtctgagtccagtatgagcactgcctccaccagctacctggagtgaaaccttaggcaaagtatttgagcctcaatttactcattatataggtataatatctaactcatagagttaagattaaaaagattaaatatattatgacaagcctagtgcttagcataaagcaggttctcagaaaatggttgctttgttagtagcaattctatgaattgcttatctgaagccctattagaatctgcaaatggaaggggtagagaggacttataaattagaaatgacaattgacactaaggacaaagtacacaatgtcaaactgaagttgtataaccacagaggccaggagccctgtccagcccacagcccctccactggcccccaacctgaaagaatgtttctcactggaagagttcagggagctttgcaccacattttggttatgataccagttaatgtgaaaaccattaggaaaatcagtgctaaccaccatttaaaactcacacgttttcctctctttatcagataaattttccccagtaaatgcaaaataggtttttagggagtctctggaattattttacaacaggaatgccgtctggtggaaaaagacctggaactaaattcctgcactgtcacagctttgaaaccacaacaaagcacctggttgtatggaacccccattttctcatgtgtaaaacaggacttcctatgttacaagatgtttatatgtaggaagtctctgtccagtatacgggatagaatctcaaaatatattttcttagttttatcacttgatgagtacagataaaacaaaaaacttactcatccaaaatgtatatttttcaaattctagggttttaggtgtgtgcgggggttggagagtgatataatgctggtgttaactttttaaaatgatcacagctgctacttaatcccattttagcaagtcaggatctggtttagcatttttaatatagtacgttccccaagtagtaattgaaggacttctaagtataaataccatgcaattataaaatcagagatttcctccagcttatttgtcaaaagaaaatcttttcgcctttgacgtgaggctctgggagtgtggtgaggttggcttagcgtgcagggcatagggagcgtagcaggtggggaagaatgtggattgggctggaagggaaaaattgttcctctgttactaaaataaaatacatgaatgaatcaccatcatggcaataattcataaaatggagtacacatgaaaaaatgtatgtgggaagacagaggaaagggataattttttgatgtgataacattcattttacaaccaaagattgtgtgtgtgtgtgtgggggggggcggggtgtttaaattttaaggagaggaagagttacaggaataggtggtactatttaaaatgagtattaatcattcaaaaca

SEQ ID NO: 14444 - DNA, 24971 bp, Human
atgtgtttggggtggtgcgtgcatgtagtccttactactggggaggctgatgcaggaggatcacaagcccaggatttcaagaccagcctgggcaatttattgagacccccccatctcttaaaaaaaacccaaaaaacaaaaatccaaatgaatgattaatgtgttgtggtagcctgtttagtttagagaatagaattcctcttaacagtaaaatcttgacgtaggaattgcttttccctctgttttttaacttttttttttttttttgagacagagtcccactctgtcacccaggctggagtgcagtggcaagatctcagctcactgcaacctctgcctgccaggttcaagtgattctcctgcctcagcctcccgagtagctggaattacaggtgtgcaccaccatgcccggctaatattttgtatttttagtagggacggggttttgccatattggctaggctggtcttgaactcctgacctcagtgatctgcccacctcagcctcccaaagggctgggatgggcgcccagcctggtttttttaccttttaaaaagtgactcttaattacgattggccttgctgctacatgatttgatgagtacgggccaaattgacagctacgcctccctttaattttttgctcctgaaattctaccactgggattcctactactagttaaccagtgccttctgtccttgaccaggcattcagaatgcagtaggtggttttgtttgtttgtttgtttgtttgtttgtttccagacggggtctcattctgtctcccaggctggagtgcattggcaggaacatggctcactgtagcctcgacttcccggtctcaagcgatcctctctcctcaccctcctgagtagctgggactacaggcatgtgccaccatgcccggctatttttttttccccgagatgaagtcttgctctgttacccaggctggagtgcagtggtgcaatcttggctcactgcagcctccgcctcccgggttcaagtgattctcctgcctcagtctcccgagtagctgggattacaggtgcttgccaccaaacccagctaatttttttttttttttgtatttttagtagagatggggtggctcaacatgttggccgggctggtcttgaacttatgacctcaagtgatcccccctccttggccttccaaaatgctgggatcacaggcatgagccaccgcgcccggccctaatttttatatttttagtagagaaaaggttttgcgatattgcccaggctggtcttgggaacttctgagctcaagccatctgcctgtcttggcctcccaaagtgctaggactacaggcctgtgccaccacacctggccctcgttcagtagatatttattgagcagctgcaatgtgctaggcagtgtggtaggagtgaggataagcagtgaacaaaagagacaaaaattcctaccctcacagagtttacatttagtgcattggagatatagtggttcaggacgtagacaagaacttgctaagggcccactgtgctttaaagctttttttttttttttttttttgagacagagtcttgttctgtggcccaggctggagtgcagtggcgtgatctcggctcactgcaagctccgcctcctgggttcacgccattctcctggctcagcctcccgagtagctgggactacaggcgcccaccaccacgcccatctaattttttgtatttttagtagagacggggtttcaccgtgttagccaggatggtctcgatctcctgacctcgtgatctgcctgcctcggcctcccaaagtgctggggttacaggcgtgagccaccacgccctgcccagctttaaagctttaactgggtcttctgttaatctcataattataaggtgataaacatttaaggcatatagtggtgctctggatttaatttatgaattgggaatgttagctttgattcatttttatggagctaatgttttaaattttatttcttgttaatattttcagaagatgaattgaatcttctggttattgtagttgatgccaacccaatttggtggggaaagcaagcattaaaggaatctcaggtaagactgcttgaggaggcctttggagaattctggtttaactgagtgtttatattgcttttttaaaaaatggctttattaaagtataatttacatactgtaatattcagccactgtacaattcagtgattttttttaagtaaatttgcgaagttgtgtaaccagccccacatttctgctttagaatatttctttgactgcgtagcgttccctcatgcctgcttgcagtcaatccctgcttctatctccaagctgcaagcaaccactgatctgccctctatctctaaattcccttttctggacatttcatgtattgatttcatacaatatgtggtcttaaaaaatactttctattttgaaatattttatttttaaataatatagacataggaaaccagaaaagatacagagaggtcctgtgtacccatcactcaagttctttcagtggtgacattttacataatgatagtacaattttgaaactatcagtgcaatctacagacctaagcagattgcaggttttacatgtgctcacttgtgtgtatgcgtgcgtgcgtgtatgtgtgtggttctgtgcagttttaccacattcattgatttgtgtgtccatcagcaccaccatctcatgcctcagcctcccgagtacttgggactacaggtgcgtaccaccatgctcagctaattgtttgtatttttagtagagatggggttttgccatgttggccaggctggtctcgaactcctggcctcatgtgatctgcccgctttggcttcctaaagtgttgggattatgggagtgagccaccgcacctggctgattcttcatgtttgttcgtttgtaatctggtcccactctcgaccacaccttctttgcctgtctgtactcccaggcaactcttgatctctttgtgtcactgtagattagtttggattttctagatttttttcatgtaaatggaatcaaacaggttatagtggggaggtttttgtggccttttttttttttttttgagacggagttttgctcttgttgcccaggctagagtgcaatggcgcgatctcggctcactgcaacctttgcctcctgggttcaagtgattctccttcctcagccttccgagtagctgggattacaggcatccgtcaccacgcccagctaattttttgtatttttagtagagttggagtttcaccatgttggccaggctgatctcgaactcctaaactcaggtgatctgcctacctcggcctcccaaagtactgggattacaggcatgagccactgtgcctggccttgtctgttctttttaatgacaggttagctgttttccacttttaaatggtttaaaataaaatcagaagaataacatttttgtgacttgaaaattatatgaaattcaaatttctgggtctataaataagcctcactcataaatttatgtattttctgtggcagcttttgcattacaaaagcagaggtgggtagcaataaagattgcatggctcaaaaagcctaaaatatttactatctggcccttcacaaaacaagtttactgacctctggccgattgtgtggtctgttctggagaatgttgcatgtctacttgaaaagaatgtgcattcttttgtttctagtgaagtgttctataaatgtctattagtttaagttgcgtgatagcgcacctatagtcccagctacttgaggcgctgaggtgggaggatcactggtgcccaggcggttgagtctgcagtgagccataactatgccactgcactccagcctgggagacagagcaagaccccgtctcaaaaaatataaaataaaaaaataaaaaaattatcgagaatggaatattgaaatgaagtattgttgttgaattgtgtatttcttttttttttttgaaatggagtttcgctctgtcacccaggtcggagtgcagtggtgtgatctctgctcactgcaacctctgcctcccggttcaagcgattcttctgcctcagtctcccaagtagctgggaccacaggcgtgtaccaccacgcctggctaatttttgtattgttagtagagacggggcttcgccatgttggccaggctgatcttgaactcctgacctcaagtgatctgcctgcctcgacctcccaaagtgctggggttacaggcatgagccacgtgtctgcccccgtttttttttttgtgtgttttttttttgagacagagtctcactctgtcacccaggctggatagcagtgctaggattacaagtgtgagccaccatgcccatttccccatattttgatagcagcagttagtgtactcacatttaatataattattagtgtggttgcgttcatatctgctattttgttatttgttttctgtatgtatcatgaattttttggttctttgtcctcctttactgtcttttgtgttaaataaatattttttacgtactatattaattcttctgttgatttgattaattcttctgtatatttttagtttttttgtttgtttgtttgttttttgagatggagttttgctcttgtcgcccaggctagagtgcaatggcacgatctcggctccctgcaacctccatctccctggttcaagcaattctcctgcctcagcctcccgagtagctgggatcacaggcgcgtgccaccatacctggctaatttttgtatttttggtagtgacagggtttcaccatattggtcaggctgatctctaattcctgacctcaagtgatcctcccgcctcggcctcccaaagtgctaggattacaggcatgagccactgcacccagccttcagttattttctttttcttttcttttttttttttgagacagagtctagttttgtcgcccaggctggagtgcattgacatgattttggcttactgcaacctctctctcccgagttcaagcgattctcctgcctcagcctcccgagtagctggtatttcaggcatgcaccaccacacccagctaatttttgtattttcagtagagacggggtttcgccgtgttggccaggctggtctcgatctcttgacctcgtgatccgcccacctcagcctcccaaagtgttgggattacaggcatgagccaccacacctggtcaatctcttcttacttgtgattctatttccaaaaaagatcatgtacacatgtaccagaagttaggacttgaacatatcttttggggggacataattcgacccacaacagttgctgtagggattactgtatgtatcttatcattgtgtactttagattaatactcatttaattccagtaaaatatagaggctttgctccaatatagatccacttccaccccttccccatgttcttattgtcatacatattacacctgcgcatgttataaatctgataacgcagtgttataattgttacttacacagttgcttacaccaagtataagcatcttttctcttgttaacaaaaaataaaaatatcagacaatattcatgttagaactacactcatttttcagctgaaaccatactcttttttctttttttgagatggcgtcttgctctgtcgcccaggctggagtgcagtggtgcaatctcggcttaccgcaatctccacctcccgggttcaagcaattctgcctcagcctcccgagtagctgggactacaggcacacgtcaccatgcccagctaattttttgtgtgtgtattttagtagagatggggtttcaccatgttgcccaggctggttgcaaactcctgagctcaggcagtctgcccgccttggcctcccaaagtgctgggattacaggtgtgagctactacgcccggcccaaccatactcatttttcaattagctatggatacaagaattcagcaaaaatcaacataggcattctgtgagaatccattgacttatgcaatttactataaagagtattgtgcattttactgttatttgtaaattgtgtgctacatactgctgtatcagtaatattcgtatgtacttgtgtacatgggtacctcggttttggggagcgaatggttaaacatccgccagcacatcactgcatgctgccctgttactccagaaaggctgcgtttgcactcatcagtgctgtatgagagttccttttttcttgtaccaacacaaaatgttcattctccttatttcatcttttgtcaatatgaggcaaaaaacaacgtaatctcaatttgcttccagtgtatttcgtggccatttgtatttctctcttgggacatcacccacttctttctttggatattcatagtgtgtggttttttttaaattaatgatttatggacagtcttttatattaaaggattaacccattacttgccatgtgttgcaactggttttttccagtttgtaacttgttttctttcacttttatttatattgtcacttttcgccaattagaaattttaatagatttaagttttttttccagtagggtgaaatttaccagtgtgttggtctattttttgagatggagtctttgtcacccaggctagagtgcagtggcacgatctcagctcactgcagcctccacctcctgggctcaagcagtcctcccacctcagcatcccgagaagctgggactgcaggcacgtgccaacacgcccagctaatttttgtattttaagtagagatagggttttgccacgtaagccaggctggtctcaaactcctgaccacaggtgatctgcctgcctcggcctcccaaagtgctgggacgtgagccaccacgcccagccaccagtgttctgttttctacctgaagtatttatttaagagaaacaggccatattccaggattatgaaaatatctacttatgaagactgaaacttcaaggatcatttgtttagtttgttactagagaagtttctctgaacatatgagtaccaaaaaaaaaatactgacttatgtttcttaataatattagttcttgtgggaaggtgagctcgaggaaagaagggatattctttatttgttttttcaaactttaaaagtttttaggctgggcatggtggctcacgcctgtaatcccggcactttgggaggccgaggcgggcggatcatgaggtaaagagatcgagaccatccttgccaatatggtgaaaccccatccctactaaaaatacaaaaattagctgggcgaggtagcacaggcctgtagtcccagctgctggggaggctgaggcaggagaattgcttgaacccgggagttggaggttgcagtgagccgagatcaggccactgcactccagcctggcgacagagtgagactccatctcaaaaaaaaaaaaaagtttttaattcatttacccactaagtatactgagcaacaactatattgttcactaagtatataccagacgtacagtagtggctcagtatagttagtgaacaaatgaattaaaaaattgtaaaggtctccagtgttttcagtatgtattcattatctactccacatatagtaatagtttgctggaaattttatcacagaacatgtgacatgtttgttattctttaaatgttacactgcaaatatttgtggaatattgtactgatgtagaaatgatctcatataagtacaattagaaaactatagttttcaagtgtttttgtttatggctttggaggaggggagctcctgagcaaatttttaacagtgaataattgtctaaaatttaaatgaagtcttttttttgtttgtttgttacagggtctagctctgttgtccaggctgcagtacagtggtacaatcttggctcactgcagcctggctctccagggcttaagcgatcctgccacctcagccttcagagtagctaagactacaggtgcacaccaccatgcctagctagttttgttttttttatagagctaaggtttcattatgttgcctaggctggtctcaaactcctgaactcaagcagtcctcccaccttggcctctcagggtgctgggattacaggcttgagccactgcacccagcctaaacgacatcttaattatgtcaagacctgacatggttatttggatagctaatttgtttttctaatgtctttttttttccaacagttcactttatccaaatgcatagatgccgtgatggtgctgggaaattcgcatttattcatgaatcgttccaacaaacttgctgtgatagcaagtcacattcaagaaaggtatgaccattgtgattgcttttgctcttcagtgcttaatattcatgagttttctgtgccagttggcatgtattgttcctactccatgttgcaaaagaaaatgttttctgtaccagtgaacagccacagcaccaagagccagtacatgtacattgtgatatccatgaaatttgcaaaccttattattagtagatagtagagttacacaatggcccatgtaatttgcacagattgaactatattatttaggcaaaaagggaaagagagctatcaaatcggacagctactttccctcacctgtcttcccattttgtgtctgccccagcgtgcaagttagatgggagatgtgattctgttttcctttagctctgcgtagttctcatggcctgtttccctgctctgtgagtgaacctggtgctttgaaataaggatttttcttataacgttggcttctaaacccaagccaactactccatctggtgcttggcagaagaaacagtggtcgcttctaacactagtgtgaaaactggctgtgttagactcactgcaagatggtgcatagcctgcagctgatgtgtaaatgtgaccgcagatacagcaaagtttttgtgaataatttgggccatatttacttctcacattatgcactgacagaagagttgaattaccatgtaagacacagctcttctatgtctttttttttttttttttttggagacaggatcttgctctgtcacccaggctagagtgcagtggcactatcatgggtcactgtagcgtctgaccttctggacataagtgactggacctcctgcctcagtctcccaagtagctgggactacaggtgtgcaccaccacactcagctaatttttgtattttttgtagagatggggtctcactatgttgcccaggctggccttgctctcctgggctcaagcagtcctttcaccccagcctccccaagtgctgggactgcagggatgagccactacacctggctcttctatgtcttaatcaccacattacaatagaagtgactcttgctcaccaacatatttcatatggtagctgtcagattttcttggttcttagggctgcctgcttcctctggtgaggtgagagagcccatgggccaccaaacacatactcttactcccatcctcgctgcatattttttctcagaattggatgaaaagatgatattagtttggttaaaataccagtaaaaactatacctgtcaaagttttttttttttttttttaatcaaaggtatcctctacctgattatcttaaaagtcacaaggccatggctgggtgcggtggctcatgtctgtaatcccagcactttgggaggccgaggcgggcggatcacgagatcaggagatcaggaccatcctggctaacatggtgaaaccccgtttctactaaaaatacaaaaaaaattagccgggcatggtggcgggcacctgtagtcccagctactcgttaggctgaggcaggagaatgtcgtgaacccgggaggtggagcttgcagtgagccgaggtcgtgccactgcactgcagcctgggcgacagagcaagaccctgtctcaaaaaaaaaaaaaaaaaaaagtcacgaagtcacgaggccgggctcggtggctcacgcctgtaatcccagcacttcaggaagctgaggcagattacttgaggtcagtttgagaccagccatacatagcagccaacatagtgaaaccccatctctactaaaaatacaaaaaattagctggacgtggtggtacactcctgtaattccagctacttgggaggctgaggcacgaaaatcacttgagcccgggaggtggaagttgcagtgagctgagactgcaccactgcactccagcctgggcgacacagcgagactgtgtctcaaaaaaaaaaagagtcatgaatcactgggagaatcttttcagggacctttgggccagatttttattactgggatagatatgtacctcaaataataaactagtagtgagttagaatttggtatgaacctgttgtggttgtcatttgagaaaggaaggcacgggcacccctctgcagcatttctgagattataacccaacgccctctgtatttccccacacttttcagaaaacactggaatcagtaaaacattctgtggtgatagacaaatgttggccagtttgcctattttatacattttttctttgtttttatacgctttttctaattttatcttacacattttttttaaaaaatgaaatttaccgtggaatcttgtgagtcccacattgttgtaattttgtttgttgcctctgctgaatttcattctgatcatgagtgagcctgggcggtgaggcctggtgtaaccaggttttttcccctgctgtttcagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtaacaacttttaaacattgttattttgcaaatagtgttgattttggaggtcctttaggctttaagttcaaagatgtgaggttctttatgttgtatgcctgcacgttctcactttttaaaaatcattttcgtcaaagttggttcattatttgcctagcctctacagcatttgacgctgctgagcagcctttacttctggaaacacgacttttggcttctacgaatgccctgtgacctgtttttcctcttttcttgaaacattatttcatagtctctatttctggcttttccttcatcttgtctcttaaaatatgtttttaattcggcacatgattttcatcttttctccctctatatgttctcatccacttttgcctttaattatcttttacatatggacactttccaactttgtttctaacccagactttctttcatgctcaaatgcctccatttcagcgtcccacagtctctggacatggcccaggctagtctcattatctttgctctcactcacaccaccatttccattccctatttctgtcagctcccatccaagtagttttctaaacttaaagctttcatttttaactcctgctcacatccgacatctaatcagctacaaaatcctagtcgtttagcctcagaagtgtctccagaatcccgctccttattgtcatctttttatttttcatttttaaaatttttatagggacggggtctcactatgttgcccaggctggtcttgaactcctgggctcaagctatcctcctgcttctgcctcccagagtgctgggattacaggcaggagccaccacacccagcccccatccctattgtcatctcttttttttgagatggagttttgctcttgttgcccaggctggagtgcaatggcacgtgatctcagctcactgcaacctccgcctcccgggttcaagagattctcctgcctcagcctcccaagtagctgggattataggcacgtaccaccatgcctgactaatttttaatatttttagtagagatggggtttcaccatgttggccaggcttgtctccaactcctgacctcagttgatccacccaactcggccttccaaagggctggaattacaggtgtgagccaccacacccaggccccatcccttattgtcatcttgatcggcctcagcattattgacattttggtctggataattctttgttgtggcagctgtcctatgcgttgtaggatgtttagcagcatttctggccttgggccattagacaccataatatcccccagttgtgacaaccagatatgtctgtagacatagccagatgccccctgtagggcacattcaccccacgtttagagccactgctctagattgttatagcctctaactggttttctgactcctgtctccccagtcaagcctttgcactcagcctccagagttatcatcttaaaaatcaaagctgccattcctgggcttataggcctttcctggctccctgctgcctgcaggtgatggtttccaaaccttagcctgaatcagaatcacctgggggaaaagacaattctgtggagacagaaagttggttagtggttgcccagagctgggcagagactggggagtgattgcaaatgggcccaaatgatcttttagggtaatggagactgttctaaaattggattgtgatgatgattgcataattgtaaatttactaaaaataattgaattgcatacccaaaagtacttttagaccagaatttatggtttgtacattataaacctgttaaaaaatcagctggaaggcttgttgaaacagtgtcaggccccactcagtttctgattcactggatctagggaggtcctgagaatttctatttctattacagtgccaggtggtgcccctatagctggttccagaatctcaccttgagagtcactggcctccaggattaagtctcagctcagcttcacagtatagtgctcaagaccttttctggtctgacctcacccatgaggtgtcagttctcctggaccagctctaagctggcttgcacagagtgtcaatctgagctccttgccctcttgaactgcagttttagggttttgatatcttgagtgacttttttcacccaaggcaccaaacaagtggcaaactcctccctgcttctcatggctcgaggaaagagcttctccagtcttccccgcactggctgagcacggagagtgatgggaaggaggggatggtgggagagggagggcaagggggcctcagagccttgtaccctgtccaggctgctagacttatgcgtgacattttgtaccacatagatcatgaataaactggaacctttccaagtaaaaacgggatctttttgtgtgtgtatgtatggtaaagtacaaataacaaaatttgccattttaccgatttttagaatttttaatgtaaaatttacttaccataaaatttaccattttgacaatatttaagtgtacagttcagtaatgttgagtatattcgccttcttttgcaatcatcaccgccatccatcgccagaactttttcatctttacaaactgaaattctgtacccattagacactaactccctgttccccctgccctctggctagcccctgaacaaccaccaggatgttttacattgagaaaaggttaaaaagttgcttagttaaccattaccaagaacacattgctatgtttttaaacctagtttgaaaatgtcttgtttgatttcatttatgaagaatgctttggtgtgaaagcatacttagttcaataaagcacccaatgattttagttcaagaaagtacttaaaaattcccttttaatgttttctgttatttgcaggtgacataaagggtcaacatacagaaactttgctggcaggatccctggccaaagccctttgctgtatccttggtgtctgaatcatttagaaggtgtcttctgtaataaacatatcttaacttgtgacatttcttaggaccttgggtgcccattactgggacatgtgagtactctgaagtggagggtaattttttaaaaaatagtttacattggctttgaatttttttttctttttttgagacagtctcactctgtcgcccaagttggagtgcagtggcacaatctcggctcactgcaaccttcgcctcccagattcaagcagttctcttgcttcagcctcccaagtagctggtacaggcacccgccatcactcccggctaattttttttgtatttttagtagagatgtagtttcaccaagttagccaggctggtctctaactcctgacttcaagtgatccacccacctcggcctctcaaagtgctgggattacaggccacagtgtgtggctggctttgaaatgtttattaagacaagctgtaaaggccgggcgtggtggctcatgcctgtaatcccagcactttgggaggccgaggcaggcggatcatgaggtcaggaaatcaagaccatcctggctgacacagtgaaaccccgtctctactaaaaatacaaaaaaattagctgggcgtggtggcggacacttgtagtcccagctactagggaggctgaggcaggagaatagcgtgaacctgggaggcagagcttgcagtgagctgaaatcgcaccactgcactccagcctgggcgacaaagcgagactacatctcaaaaaaaaaaaaaagaaaaaaagataagctgtaaaaactggaagtggggaagagtgagaaaactctagcttctccattatgtctttctgccttcaggaaacactgcttcagggtgctttcttgtttcttattttgataaattcagactttttaaacattttcattttcttcttgacttgggaacagtgtttgatttttaaaagccatttaggagccctgaagcttaataaatgagtggctccttctccataggtgaacgggttgttttgcatagggcaataccttttcattttatctgtgtgacgttttctcagtcttatggcattaattttttggaggaggggcagtattgagtgattattttgtcctggagtttgatgtgggttgcctgaacatatttgtaaatcagtacttgtcccaggattcaaatttaggacatggtaggtaagaataggacagtcaagtgttgggaattttaattttctgggacagagattatattttggtgagattacaaagtccagttgactgcagagttaggaactgaaaacccccaatcactcttgtgtatttatcttggtgagtggagcatttcccttcttagctaggtagatgctgggtttatttaaaattggaggttatttttctttttactataaatatttatgaagcaaaataatatttttgtattccttaatgttaagaaattaagacattcatagaatgaacaaggaagttaaaggtaagagcctacgttttcctatgagaactgtaatcctacttattttactagtatttctttactagactgtttaaaaattggttaggaaaccatatatgattagtaagatttagttaaatttttttctgcttttttctctttgtagacaatcaggaaatgaaatcaaggatattggtaagataaaaaaatcattacttttttatatgacaactataattagaaaacataacgggagaccaggtgtggtggctcacacctgttatcccagcactttgggaggccgaggtgggcagatcacttgaggtcaggagttcgggaccagcctggccaacatggtgaaaccccgtctctactcaaaatacaaaaattagctgggcgtggtggtgcatgcctatagtcccagctacttgggatcccgaggcaggagaatcgtttgaacctgggaggcagaggttgcagtgagctggaggttgcagtgagccgagatcacaccactgcactctagcctgggtgacagagtgagactccgtctcaaaaagaaaaaaaaaagaaaacataatgggaaataaaacgcatttatagtaggagcaaaaaatgttaactatccaggattcatttaacaagcaatgtgtaaaactgatgataaggaaaactaaaattctgagagcgatagaagaataagtggagagccatattttgttcttggatgtcagttttcccaaaatcacactgtaaattcaatttacaatctcagtcagaatatcagggaggtttttttttttcctggcagggtggggagatttaaaaaagaaattcaaggctgagcacggtggctcactcctgtaatcccaacactttgggaggccaaggcgggtggatcacgaggtcaggagatcgaaaccaacctggctaacatggtgaaaccccgtctctagtacaaatacaaaaaatgtcgtgggcgcctgtagtcccagctactcgggaggctgaggcaggagaatggcgtgaacccaggaggcagaggttgcagtgagccgagattgcgccactgcactccagcctgggcaacagagcgagactctgtctcaaaaaaaaaaaaaagaagtgccaagtaacgagatattcattgtttgttgcttagcacaaatgaaaaagctggcagttcccagggttgatggtgatgttggggattgcttattctcatgggttgctgataggaggataaattggtaaaaatcttttctggggtgcattttggtaatctgtgtcaaaattaaatgttcatatactttagtaatcactgcttattttccggaggtaattagagagctgtgcagatggtatatgagggtatcatcagggtattgtttaaaactgagaactggaaactgcttaaatagtggaaatttatgaagtccgcaaggagcatagtatatattataattcattgacattagaatattttttcccacatatattgtggactgaaaaagcaggttgcagaatgctaagtaatcatcttgatacgtgtgagtgtgtgtattttggatgtgtgtgtattctggatgtgtgtatgtgtgtatattttggatgtgtgtgtgttttgggtgtgtgtatgtatttggggtgtgtttgtgtgttttgggtgtattttgggtttgtgtttgttttatgtgtgtatttggggtgtgtatattttgggggggtgtattttggggggtatgttttggatgtgtattttttggggctgtgtatttggttgtgtgtgtgtgttgggtgtgtgtatttagtggtgtgtgtacttttggggtacgtgtattttggttgtgtgtgtgtgtattttgggtgtacttacctgtgtattttgggtgtatgtccgtgtgtgtattttgtatatgtgtgtgttttgggtgtatgtgtatttggggtgtgtgtatttggggtatgggtgtattttgggtgtgtattttggagtgtgtgtatttttgggtgtgtgtgtgtattttgggggtgcatgtgtgtattttgggtgggtaggtgtgtgtattttgggggcgtgtgtgtattttgggtatatgtgcgtatgtgtttattttgtgtatgtgtgtgtttgtgttttgggtgtgcatgtatatacctgcccatgtaggtgctctccagaatgagttcatcaaaccgttacgtggagcgggatttcgggggaaatgttactgtcatctttatactttaggtatcatttaacaatgataaatgggaagacaaactggaataatgttggttgtggttcgcagtatattgtgtgacattggtgtgagaggactggcatgtgcctgggtggaattaacatgactgtgatttttaggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgctatagccatgcataatgttctctgttgtggagtggcagcatgatgtagtgaaaagagcctggactttggagacatgccgagtggggtgacagctttctcacccgctggctctgtgaccacagcccagccatgtcctgggtgcttcagctgccaaatgcaaatatctgccgtgcagagtcacgttgcatattgagtgagctattttaagcatagagtatggcatgtagtaggttctcagtatagggtaatcattattgttattattcctgtaatattttcaaaatgtttcttttagaatattttgattgatgcctgtgttttagactccgactcagggctcctccaacaggtatgttttaaaaccatgctttgtgtcggtggttatgacaattagtgatttttatattgattacaatttaaaatgaaagctttgggtatattgggttaaataaaatatgttattcagcctaattttatctatgtctttcccccttacgtatggagctactggaaaattttaaattacatattgcttgcgttatatttccgttgggcagcactaaaagacaaaaactgaattttactttaacccgaaagggaaacaaaaccctaaagtaagtctgaagaaattactgagtttttgttagatgttttttggccacaaatgttgtttcctaaaggatcagttacaagcacaaaactatgacaaaccctgaatttaggttactgctggggatgaaggatggggagagcgaggtccaatgggaaaatttacatgcttcaaaggctctgagattgtactgtttcttcagcttgatcgtaggtatatgatgttcattttattatttaaaccatacttacacattatgtatacagactcttgtacatattatatttcagtagtaaaaattcaaaaagtttgaattcattttttagcaacacatttcagtctacacattgtctattaactccaagacgatcttgtctctgccatgaattcacataccagctctacctcctcagccctcacattcatttttctagtccagtcccagactctcctgagttccagacttgcagaatcagccgtgtacgtagtacctcctcttggacgtctggcaggcatcttcagtgtcatgtgtcaaaagcagagagctcttggtttgtcctctcagcctcttcctgctccactggtagccccatctccctaagtggcagtgcagttcactcagcaactcaagcaaaaacctgactcttccttgtctcttctcttccctcctttcataaccatgagcaaatcctgttgattctgcctttaaaatatatcctggctgagctcagtggctcatgcctataatctcagcacttgggaggctcaggcgggtggatggcttgagctcagaagtttaagaccagcctgggcaacatggcgagacaccatctctataaacaatacaaaaaaattagcctatcatggtggtgcacgcctgtagtctcagctgttcgggaggtggaggcaggaggattgcttgagccaggagttcgaagctgcagtcagctacgatcatgccactgcactccagggaaaccctgtctccctcttaagaaaaaaaaatgtgaaagttggttctcagaacagctgtcagaatgaagctttcaaaatacaagattggtgcaaaagtaattgtggtttttgccttttttttttttaacagtaaacactgcagttacttttgcaccaacctaatataaattagaacctgttgctcacttgcttaaaaccctcccatagcctagcatcatacgttgactaaaacccagagtcagggcctgccagggccttccagatgctgcttgctgaggctcctgggaaccttttgccccgcatcttccacactctccctcttcagtccggccccaccgcccccttgctattgcctgaaacaggcctgcttcggccagaggggcgctgcactttctgttctctctgctcgcaagctcttcccgcaggtgtttgcatggcctactccctgcctgccttcacgtctctacttctgtgccacctcctcagagaagccttccctgaccaccattgttagtgttactccctctccccttagcctactttatttttcttcatagaaatgatcataacctataacattatttttgcatttacttacctgatttactctctgccttctccactagaaccttaacttcatgaggatggacactgtgatgtttactgctgtaaccctgcacagtgctctaaaacagttgttaaatgtgtaaatgaatctaacggaccaactgaaccaggactgtactatcagaggagcctcagggtcctaggatcggagctagggttttcagtgtaaatggaagcactgctgtgttaaagcgagaaagctgtgtttatgaaatgaatagatgaatgattgttgggaaaaactattaacatggacaggaaaccttagtgtcagcaaccaggagagcttgagtgttttgtgtctttggaaaactctgaagatagcaaaagtttggaaaaagaggaccaaattcaaaagagttttatttttattttattttattttatttttagacagagtcttgctcttgcccaggctggaatgcagtggcatgatcatggctcactgcagccttatcctccccagctcaaatgatcttcccactcagtctcccaagtatctgggaccactggcatgcactacaatgcctggctaattttttaattttttgagacagtttcactcttgttgcccaggctggagtgcaatggtacgatctcggtgcactgaaaccccaactcctgggttcaagcgattctcctgcctcagcctcccaagcggctgggattacaggtgcccgccactacgcccagctaatttttgtatttttagtagagacagggttttatactctattggttaggctggtatcgaactcctgacctcaagtgatccgcgattacaggcgtgagccaccgcgcccggcctaattttttaaatttattgtagagacagggtttcactatgttgctcaggctggtcttgaattcctgggctcaaacagtcctgaagccttggcctcccaaagtgctgggattacaggcatgagccactgcacctggacaaaaaagtgttatttcttaaagagaacagaataaagccatctcacagtttctttttacataataaaattaacaaaatacaatgaaaacaaatctcataaaaattaaaaatttttgtgcttccaagggcactatcaagaaagtaaaaagacaactgggagagatatttgcaaatgatgtatctgataaagggactagtattctgattatataaagaactcttaaaattcaaaaataagacaaataactcatttcaaagtgggccaaggattgaacagctatttctccaaagatctgcaaatggccaagaagcacatgaaaagatgcttaatatcattaccgaccagggaagtgcaaatcaaaaccacaatgagctattacttcactccactaggacacatgtaatcaaaaagtcagctaataataaatattggtgaggatatagagaaattggatccctcctacattgctgctggaaatgtaaaatggtatagccacttcaggaaacagttcagaacttcctcgaaaagttaagcatagaattaccatgtgactggggaaaccccgtctctactaaaaatacaaaaattagccaggcatggtggcgcatgcctgtaatcccagttactggggaagctgaggcaggagaatcacttgaacccaggaggcagaggttggagtaagccgagattgtgccactgcactccagcctgggcgacagagcaagactctgtcaaaatataaaaataaaaataaaataataataatctgcagtgtcatatcctcctctgattttgtaggcccaaggcattgctcatgagaacctcattcctctggaaaccctaggtaagtgcgagtttggcagcaagccgcctgtgtcttgcaggcttgtgacatcacgggaggactgtacctgaaggtgcctcagatgccttctcttctgcagtatttgctggtaaggagacagcagcggcgaccctgatgcctggagggaaggatgacctctgtgtcctgggaaaggaatggaagcaagatggctggtgctagtactcaggagaagggaataaatggaggccttggagttccaaggcctagaagggtgggcttcatgttatttttttcccatgttttaaataaaagtttcttttgtttgtttgttttacagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaagtaagttaatgtacctagtttttcttttttttctatgttggggggcaggaaaacagtttctcagctgtgttgtttttcagccaccctattgtttctttttttttttaatttacagtattctgcaatttcagccccatttgtactacgtgcgagtaagtatctttgagattgtgtgggtggctaatacttcacagctctagaacattaaaaaatgttttcctctctgtaatttcaggacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatcaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaaagtctgtactgataaaacccattgtgtacaaaactttgtatgtaaggaagattttaattttctcttt

SEQ ID NO: 14445 - DNA, 203093 bp, Human
  misc_feature (1)...(203093): n = A,T,C or G
agtgacagtggtgagatagacctgctggccttgctttcgggacctgcagcaagatttttgggtgctgtccaagaattcccgcggttacactcagcgcccaggatctgtacaaaaaagccccaatagatgttttacgttcccttcgtaataattaacgcttggcctagatccgagcattcactctaacgttcggtttcttgatccttcccatccccaaactctgcgggtagatcagtgactattactatattttgaacgagactccaacccattgctctctctcgagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgaccggggccatgggctggtgctccggagcgtgccgggcgctctctccccgcgcgggggcaccagagccctcggaagtgtcaggcactgcggtgtattttcccagttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaaggtacggcaggggagcaagggcttgggatgccctacgtgggggtgggcatcgcggggagtgaatccacgatctgggaatggctacatcccgtcaggttaaaggatgagagaaaatgacgcggcgccacacatcggacaggccagggtggccaccgagcatttagaatacgcatcaggcgcgctcccttcccctcacatgtctctatttcccgggcgtgtgatggcagaaaacggcaggaaaaagacccacttagagagctagaattgtgtttggagactcccttccctctgcaaaagcaccaacaggaagcccctccaaaaccaccgatccccaaataggtggcccggaatgggggcggtgatccttggttaccaatgcagaacacgttttggtgtttacaacatttatttatttttaggatagcttgccctcccttttaggcagggtgggaaaggagaacgcggggagggagaagggagggaggattcctataataagaatcagcgcatttttcagagctgaaccaagcacggtttccatttcaaaaagggagacagcctctaccgcgattgtagaagagactgtggtgtgaattagggaccgggaggcgtcgaacggaggaacggttcatcttagaggtacctggatgtaaatgcacacacacacacagacacacacacgcacgcgcgtgcatgtctacacggccaggatgtgtgcgtgtgtgcgcgcgtgtgtgaactcccacatgctgctgctgtctgcttctggccagtggcaccgatgcctccctcctccctgctcgcccccagattcccctcccctccctggtgcttttgtctggagggtgttatgggtttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcattcccctttaaagggtccttcgcccggcctgtaccatggaatcctgtcttggggaccctttccctacctcccctcccttggcctcaggctcgaagagagagtgggcacactggtggctccagcggcgtcagtgccatcgcggggcaagttgattcctgggccggagctgggcactcatccatccacagtctccgggctggggtcggggtggggatgacgcgagcagagagggagagtgccccaattagtggtgttgggggtcctacgctcagtcttacgcgtgtctgtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaatgtgagttcctggagcttttcctcctttttctccttgcccttagggcccgagctggccaggtgggtaggtcctggaagtgaatgctgtcccaagagtggggagaagtcaaagacaagagatgcaggacagggtcatctgtcagttacctgctgtttcactggcttgggactgctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcatttttgtttcataaagtgctgtgtgtatgttgtgttagaagttccattaatattcactagaaaagaggttaaaataattaactttcccaaatctgttgagggaagtgacagtctctcccttaacatcttttttgagatttaagttaaccaatttcccttttcattttatatatcggattttgcttaggagatggcatccagagatggccttgaaaatgatctgtaagaggagaagttctgagtgttgaaatgcactcgctcaaaagaaaaaaatatgatagttggaagcctaaaagcctggtctaatttaatttggacttgacttcccagagatatgattttgagaccacttggattataactcttaattgcccattgaataatttcccaggactaggttggatgataaagcactgggtagaactctgatgaaggctggctttagcattggacctctgtgtccctggaaatgtttgagcttgttgtggcttgaagaaacagaactgtgtatttctattctccttttctgatgctttgtgacaaatgcatcaccaagcaagaacttgccagtcctttctctagcattcctgtgtcacctctactggactgttattgttatcatttttttcctgaaggatgctgtcattccatacatctcattaacatgagattttattcgtatacgtggaagattgtaaggcaaagtttctcccagttttccttattgtgtttgatactgagataggcagccctaaagtggggcttgggctgtggccttccggttgtcgagtgcgcatgcatttttccttccacagaaaacatacaaccatgtttctgccaacgtagttgaccaagataacctgttttttaatgtaagtaagagaccttcctagtctctgttgcctgttctgctgctgatgcttatggtgtaagcctcaggcaaaaggaaatgacagcagagcagaggggaatgttcaggcctagcatagctgagatgtgtcgggagcagccaactgtcgggctgagtccagggtgctaggatctctatctttttggcaaggagagcaggagccaagagcggagagcaagggtggatagggccccaactgtggtggtcttggactgggctggttgaggcttaccaggctggtccaaagtctgtggccttttgtcagaatctttttcatgagatggggtgtcagtagttagatggagaaggccatatggaattcagagtgcttctgactgttttgagattatggggagtgccttccacagtcagatattgttgtgtgtgtgtggtggtgcttttaaaattctgttttaggtgatagatgcatataatgaagaaagaaagaagatagggctgatcattttcactttgtttttctgtttgataattttaaggccatgatctgagaaaaaggaaataaaactatctttaaatctaaaaaattattatttcagaccttcctgatcttagctgcctgatgtatatgaaatcaattgatttcagcagagctttcttatatctgtcctcacaattgttgttgcttcttttatatctgatggcaggttcctattttcagcttttttaaagtagattttaaaaatatttacaaaagcatgtgtcatagttattcattcaatcgtggcacttctaatttctactctaacttttttcccttttgatttgaaaacctcttggggttgtgggattggagaggtatatagggctaagtgttgagaacagggaattaggttagtaatattagtctggctgggtagatgtgagtcctgagacaaagtatgtttctctgctctatctcagctttgtgtgagcccagccagtttgtgccccagtgcctttgtctgtaactcgtatgacaatacttctttggaaagtactccatataattattttgaattctgcttttttgacctaaaaatgacatcagtggatgcgcttgtttcactctcatccttatatgacaccatctatgttctttttcttacatattaatatttgcttgcacagcttttaaattcttgtccagtggataccagctacagttggaaccaaattatacatattttaaaactttgttgttaggcccagtggtattcctaaaataacctgttgtaaagttctggtttagtggtatgtagctgaagttacgtgcgtctattttttaaaaatagaaataatgtggtgaataaactgtgattagcaacacacaacttgctgaaacaacggtttaccatatcattcaaaaatggtgtatcttttagcatctatatattaaaccatcatgcccttagggttctaagaacacaaatagtgggacattaaaaaaaatgtgtagattaaccaagaggtaggatctttttgttttgttttgtttttacatgcatgctttcagctaagctgacattttgtcttcagagtcattgaacctattttattaaaaatcttcccatcacagtacctgttttatattttttgcccactaatgtgacataactagatcaatatctatctataggtatgtatcacgcctgctcaacatcacactgctaagtggcagctcctgttatttggaaatggttataccacagcagtgttaaaatgaatttaaacgcagtaccaatgtcacatgcaatggaattcaagagtgaagcctgttgttggaattatgtaactggccgtttaaatcccagttgtattaagtgccaaagtgcattgcaaaggacaagttctgtttcacccaagtggtaaaaggcacagtcaaaagaagtcgtgcatttttttagctgtggtaaaaaaaaaatacataacctaaaatgtaccatcttacagttcagtagtgttctgtgtatccatgttgctgtggaagggcatgcatttttatgttgcacgtgctttatgaagactaatagggatcttttttttgaatttctccagtggtattctctgatttgggggtaatatttgagaacagccttatatttttcctcttagcacaacctaaatagaatttgaagcttctcctatgacagactctatgtgcaatttattgttggcctggttaagcagctgtaatgttgtgtcattaatacattgattttggccctcttactttaataagctttgccattgcaattaattgtacttaaaaaaaaatcctggcattcacaaagattcagtgaaaggcatcaatttttattactctgatgtttacttctcagcccctccattgggggttttagaactttggactgtgtcttatatgcatttaagagccatgtatttaaatttggagcacggttacataagccacactagacttgttaatgaataaggcagtctaatttacatcattcattatttaatacaacttgcaagctggagttgagaacatgctgtcttcatagtgtaggtatttacagacatcagcttggcacaactgtgtggagtctttttagtttcataccttcaatctctgcaatatggacacttttgttaccctgggtaaaacagtggaaaagccttgtgacccttttgaccctactttcttccacctccccttccatcacccattatttatacaggaaaatgggtttgatttttttcttctctgaaaagtgatatttccttatgggaattcagaatgctggagttaagagaagagcctgggctgtatgttattacaagcaagtattgggaagttgaagcaatgtggtcccagttccctagtgtggagtttaggtctgtttaaggtctctcactgtttctatcccataaacctctgtttgtgtctgcttcaatattcccttataaaggtgttttctaagctgaagagttggctgaacagctgagagttgaggtctctttctccctagtaatattctgtatgatctctttgactatatctaggtcataggagtataaaaactagtgtttttgtttagctggggaaggggaattgaatttcttttctcttctcctttctttctttctttcctttttttttttttttttttttttttttgccttgagtgttaagcaagtgcatccagttttaactcattggtcatcttgcctgctagggaaaaaaacattatcaaaccattattgaataccataaactggccttatccctctggctaactttaccacttctctagagagtttcttgtaggttcaaaagctatagcgtaggatgtgacatgaaagacctgccccttggaacaatgccaatttttagttgcttctgatgcctgtaatcaataggaggatttgggggagagactattgaagcatggcaaagtttttacttgtttgatgtgtgtttgtgagagagagagagaaagatagagggaagaaaaaaaaccctgaatcttggattatttatggttgatcaatcatttttatagtctacttggttgagctattttaaaacaaatcccacctcaagcctcaaatggcaaagatctgagctccactgtggcctgataattttagctcacatttgattgctgatcaatctccattagaaaagtaaaggtcccatataactgggtgccttctcaccacttactttgctctctggggtgtccaaaggactgggaagttataaatattgatctgggagatggatgagtgaatgtgctcaaagttacaaaaatcttgcaaagaaaagcaatgtgtagatactaagtttattccttatgtgtttcaaaaaataaaaataaaaaagcatatcatggaaagctgaagtcaggagacctggaacttcatcccaatgtcaccactacccagtcactacccagttacctgatcttgaagcagccttttaatgtttctgggcctcagcttgtcacatgtaaactgagggctttggatttgatgctcagacaagtttctcaaggctctgaagttccctgaagcctcggtcacggagataaggaagtgtatacatcagctgtgaaggaagggcatgatacaaggtgctcggggtctggcagtgtgtgaatctgaagacctttggtgtcagagtgttatgtggaaatgttttcagtgtctgctctgaactccctcaaaccatgtctttttaaatgtgagctgctaacaaggctagtggcatgttagtactggtctgatgagtccaaggtcacagggtcagtgttcagatgggtcacttagaatcggaacctcagaaagagaaagggctttagaaatgatctgcttcagcctcttctttgcaaaaatcaagggcagtgaagaaagttgccgaaggccgactcattaacagcattgtgggaactagaagctccttctcctagcatccaaatgaatgctgggggcctttgctttagggtgcctcccctccgttctgtgttctcaaacagaccgcctaattctggctcatcattttattaggttggtgcgaaagtaactgtggtttttgccattacttttgcaccaacctaatagaaccaccataaatggggagacaagtttaacatggctaagtctgtgcaaactcatctctgtgagagaccaagtaattgaaaagtgcatgagctactgatctgaaagcaatcatcttatcttcatataggaagaaatatattttctgtttagcttactgtgtgtgagtgtgtgtgtgtgtgtgtgtgtgttaaatttgaagtgttcctcttctttaggcaattcatacacaaaaaatttgagcttcagagaaaagccttcatgagttggcagcaatgaggtatgctaaccttgggcctgctgggccatctttgcagattggcattagaagaggggcagagcagacagagtgaaatgaaacctgttgcccctggagtctttgccacagtcgggggtgcttatgtaagtggagaaacccgcagccctttcgatgaggtctgtgttagctgccctgaaagacctgtggccagagagtacttattattccccgacttctttcttccccctgacttctcaatgcctcaagattgatgactagtctcagtggctgagccagtgagcaaacttcaggattattggctcccatccaaaattcatccagctaccattttatgtgttgttcgtgttctgctctgagacctttccaggaaaagcacccttctgagacatatttttggttgcatgaagatttgctcccatgggacgtgaagggccctttacagacatctgcttatttaggtttacagcctcactctgaagaaggtggggaggttttggcagcctctgaggggctgtgaggtttattagtttgcctgggccccttggtaaagcagagcataatttaggggtaggatcctatctaatgtctcatttagggctctgtctactccaaccttggtgcccaaatttgacctcgagagccaaggcaattctaggagaggtctagagatttgaattcatgttcacagattaaacttcatgcagtgggaaggaggtgggctggtgcttcatcctctgtcttccccacccctatcctcttctcctgttcagctcctgagcagtctgatatatattgtgaagagataaatgatttggttgcctttggtaatatggcatcttcttgtacaaaataaaactgttaataatcacacaccatttagagttcctttttttatgtcaaataaggacaaattgctacttagcatcccatcctttcctgtaatcttcatatcccaagaattgtctacacacacacacatagacacacaccataatgttgtatgtgtgtaccgtgttttcatcaatacataaatctgtgtataaaactctgccatgtgtaatttgttcaacttaattatcttgagttgtaaaattttctgaataattgagaatgtgcttccctaaaccactattttaattttgtttttatcattctggatgtcccttggccaggatctggttgggctgtcttctttgagagaagtacttgagcattagtgcattgaccctgttagccgacctggtcactcagagacccactgtgtctatcttctgattctttgatatcttctcaacataaacgaacaatgtaaacaaaattgaaaggtatcggaattttggtttcaacctctgcaatatagtgcaatttaaaaagaaaggatcttctcaacgctaatctttgtaacaagagttgtttctacttcatgtaccccagagtcccttgctgtgaggtggcagaggggcctatgcctgaattgtctgactcttgctcactgtgtggcaagtgacctctcttttctgggcttggcttattcctctgtgtgatgcatgtgtaggggtggagggtgctgggcaagagagcttgacatcatagcccctagattccctggtaaggtgtgacaaaaaaacacacaactatggtgaaacaaaacaaaacaaaacaagtgtctttctccaaagaacaaaacaaaaccccaaaccagaacactctttttagtttactcccaattttacttcaaaaccctgctgctaccacccaaactcaaagaatgttatagatgatattgctccttggttatttcttgtgtgcgtctggtgctatggcttgaatgtttgtattctgccaaaattcatgtgttgaaactcagtcaccagggtagtggtgttgagaggtgggagttgattaggacataaaggcaaaatgggattggtgcccttataaaagagactccagagagcttgtttgtccttcctgccatgtgaggacacacatagaaggtgccatttatgaggaatgggccctcaccagatatgaaacctcccagaaccttgatcttagacttctcagcctctaaaactgtgagcaatacatttctgttgttataaattacccagtctaagatattttattttagcagcccacatggactaaggtacatgggtttggcctttctctttgcaactcttcagcctctttctgtttctggtggtgtttcttatccccttctcctctgttcccaaatcacagacatatatatacaaacaatcatttggctgtaaaccccctttaatggattgtaaagaaatcttgacttgtgtacttttttctggtggacgacctgtgggcagaccatcattgtttcaactgaacctggcttggtaaggttaacacagtgggaaaggcgacaaagtataggaacgtggtataactgaaaggagcgctggttagggatctaggattttggatacccactctctgacagtatcagggtctgggattttggttgagccacttgacctcaccagcctgactgatttcatcttgaacctggaggctgtgacactcatgcatgctactccttgaaagactctgtggttctgaatcagtcagccatgagcactagtgtttccttttctgttcaagaattcaccattgccttcactccaggggcaaacaagagcctgcttcagttcttttggtggctaaacagcagaaacctgaccagtaggttttctttaagtccagctctgccgttgaggctggatggttttgcaggtcaccagcttcctgccatcctgggtgacagcccttccatggtttcccaccaatagaaacaaatttttatttttttccctgggagtagtgttcaagactttttcagcccattcctggcccacttctgtggatgaggctctggcaagttttctaactgacctctttggttagtctctgttttctgtgacccccaagagcagaagctttcatggacatcaaatcttatttttctgctcatcaagttgtcttttcatcttggtggaatagtttgtcacatttcctgattgtcatgtgggtgggctgccatcatgcaaaaagtagttcagtgtcactagtgttattgaggacatggagatgtccaacaaacagggtactctgcagaggcaaggagcccctgagcagcttatatctagcaagagacagatgcatacacatctaaacactcccaatagtgggaagcattgatgtgtagatgggatgtgagtaattcccaatccttacttcctatggtagcagtaatccagctgagtttcattattttctctctgtcaaataatttttgatattcctggggccacctccactcatactgcattagagtaagctgcaacttgcatctgcaaccagttacgatggaagggctggagcgcctttcagctgaagctaatcactcaacctcgagcttttttctatcagcaattttccctctctcacatacctgtattttctgtttctttctattgttccacattttaagataagaattgaagcaggttcatgttcctcccatcttagaaaagtttttctttagtgtgattccctccctctccttctgctcctgactaaagtacctctcccttcaaagccagatcttggaagagtgatctgtattcattatgtctattttcctatctcttataccagtcccattccactgtttttcaaactcacttcaccatagtccccagaagccttcatgggccatattgctctgtccttatcttacttgacttcttagcagaacttggcttcatttctcactccctccttcttgaaacatccttttcctttggccttggtgtcaccacacttttcttgttttccctctatctctctgcatgctacttgtttgctttatttgtcggttcccttttctctgctcttaaaaacagaccttaaaagtttatgtcccttgggattctgtcctatggctgcttcacttcctgggctatctctgggctacatcaccctcatccattacttatgttaccttctttgtgctaatgatgtcctaatctgtttccccatcaattatcagtgaagacctttggactcatgtgtgcaatacccctctcagatacaggagagtgtgtcacacttcttatttctaaacaaaatttttcattgttgccccaaacccattgccagtgttccctattgtaatgaatggcaccattatccactcagtaatacaagccacaaaccgtgactcttccttctctgtaacccctacactcattcacatattacgtcttgtcaatccattttcctaagtatttcctaaatctaatttttaatatttccactgacattattcaatcattctttcaacaaatattgattggggtcttctctatgttgggaactagctaggtacatgggatatggtgagaaaaactgccctggtctcttcttaccgggcttgcagtgtgtgggagtgggggatggggaacaaacatctaataagtacttaacataaaaacaatataattcatgccatcatcatcttttgcctaaaatgctgcaatcgcttcctatttcgcatccccgcctccagtcttgtcccctctctgcccatacgccacactgtagctggagcggtctatctgaaatgctgatcttatcctgtcactgcttataattaccctctggctcccagtgtctcttaaaataatgcctaaagttgtttatttttgtttcagtttttaaagaatagaacaaaattgtcactatattgctatataaagaggcatataactattacatggaccagaatgcacagatcagcataacagtctttttctacaccagcagctctataaaaaagaacaaattataactggaagcttgcttggtgatcttggaattagagcaagggcatttaattttgcatttaaaatgttaaatggcattaagctaagcttgcctgaggcatccatctccataatgggagagccttcacaaagggaatgtagaacttgaagtactttggcccagacttgtatcccctggatggacactccttttcctctccttcattcactgcccaacaccaatgctgattgatgtattctttctttggaaaggttagtgcctttaaccaatgcttctcatgtctgggagcctttcaaattccttaaagtgattttgcacatcttctctctgaaatgcattaactttattgtatggaatttagctggtaattatattttttaaagtaatatttgaaagtgatcagaaatgcaagcagcgcaaaggagtgtaccatgaatacactttgtaactcttgttacaaagagtgtaccttcactctgaagaagttggggaggttttggcagcctctgaggggctgtcaggtttattagtttgcctgggccctttggtaaagcagagcatagttagggataggatcctatctaatgtctctcttagggctctgtctactccaatcttgttgcccaaattcgacctcgagagcccaggcaattccctcccaccatgtactcccaccctctaaaatccctcagctcccctctccaataacaaccactgattttattttgtgtcggtcccctttcagaaatctttgtcttacatatatagcacatatataggtctttttagtttgtacacaaatgagggcatgctataccccctcttctacatcttggtcgtttttcacttgacgatgtatcttaaaaatgtttctggataaacatatgtaaccaaccttattttcttcccagctgcacagaaatccactggatgaatagactctatttaaccaacttcttactggacaactccagtgtacaagttcttgtgtgtaccttctacttgtgtcctcacatggcagaaggcacaaataagctctctctggcctctcttataaagggcattaatctcatcccaccctaatgatgtaatcacctccagaaggccccacctcctaacatcacatgcataattttatctataggaaatgttcctagaatttgaattgcaggaaaattgcaagatatttgtgatttgtgtgtgtgtgtgtgttttcttgttgcttattttactttaagttccgggatacatgtgcagaatgtacaggtttgttacataggtatacatgtgtcatggtggtttgctgcacctatcaacctgtcatctaggctttaagccccacatgcattgggtatttgtcctaatgatctccctccccttgccccccaacccctgacaggccctggtgtgtgatgttcccctcctgtgtccatgtgttctcactgtttaactctcacttatgagtgagaacatacagtgtttggttttctgttcctgtgttagtttgctgagaatgatggcttccagcttcatccatgtccctataaaagacatgatctcattcttttttgtggctgcatagtatttcatggcatatatgtgccacattttctttatccagtctatcattgatgggcattttggttggttccaagtctttgctattgtaaatagtgccgcaataaatatatgtgtgcatgtgtctttatagtagaatgattaataatctttgggtatataccctttaatgggattgctgggtcaaatggtatttctgagactagatccttgaggaatcaccatgctctcttccacaatggttgaactaatttacactcgcacccacagtgtaaaagcgttcctatttctccacagccttgccagcatctattgcttcctgactttttaagaatcgccattctgactggcatgatagtatctcattgtggttttgatttgcatttctctaatgcaatgatgagtgaggatgatgatgagctttggttcatctgtttgttggccacataaacgtcttgttttgagaaatatctattcatatcctttgcccaatttttttatgggttttttttttcttgtaaatttgtttaagttccttgtagattctggatattagacctttgtcagatgtgtagattgcaaaaattttctcccattctgtaggttgcctgttcactctgatgatagtttcttttgctgtgtagaagctctttagtttaagtagatcccatttgtcaagtttggctttcgttgcaattgcttttgatgtcttagtcatggattctttgcccatgcatatacctgaatggcattgcctaggttttcttctagggtttttatggttttgggttttacatttaggcctttaatccatctagagttaatttttctataaggtgtaaggaaggagtccagtttcaattttctgcatatggctagccagttttcccagtaccatttattaaacagggaatcctttccccattgcttgtttttgtcaggtttgtgaaagatcagatggttgtagatgtgtgatgttatttctgaggctcagtaatatttgtgatttttaagtaaatattgccaagttgttttgcaaagaggtcacatcattttgttctcccacagaaactgggagtgtctgctttcctacaattaaggcagtactatttgtcgttgaacttttgttatcaaaccttttgtcctttgtcaaccagtttcctgagaaatagtacctcaattgctgtattttgcgattatgtaattatgattcagattgaaagtcttttcgtatgtttgtaagtcattggtattttttttccgtgaacttagcccttttcttttttaattgaattgatggccttttcaaaaaataataaaatttgtacttcacctaatgttttgcttgtcttctaatgtcagttaaggattatgatatttcttttcttctcctccttctcttcctcctattttgtgaagcagaattaagtttttttctagtaaagcttattttttttttctatgttgtaggtgtggctaagaagattattcccttttctaagagtataaaatgagcaattttatattttcttctactacttttactattatatgtttttacttttaaagcttttgtctatctaaattttaaaaatatatggaatgatgtaacaattgttttattattttttttttcagtatagccaatcagtttctggatcttattagttatgtaatgctatctttccctcgctaatttaaaatagcaatttggttctgtggcaggactacctttgtgtttgggcctgtttagggatctagcctattccattaatcagtctgtctatttacatgccagcattaaattttatctcccacagcttcttctttttttttttttctacttgaagtattagtgtcttactcatcagtcttctttcagaattttcaggatgattctagcgtgatgattattccacatgaattttaggaactgcttgcctagctcccctgcttgatagtggtgtttttaacaaagatggcattacacttatatagcaaaggctgacaacttcttatcaagtcttgaaagccccgtgtcctcaaattcaaagccatttctcagcctcatttcatgcctctacctttgtttgatgccatgatacagccactctgagttttcaatttatctactgagctatattctcacttatcttccaggttgtcctctctgccttctaccctggctaactcctgcttatcttttaggccttggctgtgatgttgcttcctctgcctctacacctggtctatgtcccctccactacatgctcttatagccccctgtgtttcacatcgcagcgtaggtcacttagtatcatcagtgtgtgcctgtgcacctgtctgtacacaccgttaggacataaactgcatgaaggcagggacatatggatcttgtttactgctctttcctagcatctagcacaatatcctagttctctgtgttacacaaatacacacggatatgcactcatgagcaccttctccccacccccatatatatacacataaatctatcatctagaactctaaataagagtattagttggtctctgggtcatcaatatgtaaatctctagacataatttttctcaagctatcaagttaagatgtttgtttatataaatgacctttatggaattaaagtgcacagtgttagttcatgcacagcaagagattgattaattgtggaaaggaaaaaaggcaaagccttgatgaggcaggctgattacatatccaacaggaaggagggacagcaaagagaggggaggatgagggcgttctgcagatgaagagagatgcagagcacacaagctcagcaacagaggaaaatccaggggaaaagaatcactccagggtcacctgatctccaacaaacaaataggtctaatgagaaagatttgtgccttttctgttaggtaatagctaataatggatatccttgtggatcaattgcagttttccctgcgactgcatttatggggcttcacttaaaaggcaattctggtgtgagatttcggatgtgatttatccttcttggagtacggatgatagaggctgttcatttttctcaaagaattgcaaacatcaggagtataaaaagataatgtgtcaggtctagtttaatgtaccatctgatacatatacttttgcacttttgcagtaaaaatgcattgggctgatcctatgaatgtttcatggggcttcctttatatttataaaaattaacgctattagacatttgagaagttttgataggtgcttgcaaaactcatcaaaaaacccaactgatagacatatgagattagaaggctttttaaaatagagtgaagtctataggttaataaattgtgttgaataatcaaaaagataattctttcttaagataaataatataaatcatatctattgatgttttatttatttatgcttatataatcagtatattcataatacgtatacaaatgaaagtggtttagactccatgtgtatttgaaaattaaattttaaaaaatgaatgggaattatgtatttgacgggtttttttcctttttttgtggagacagggtttcgccctgttgctcaggccggtcttgaactcctgggctcaagtgattcacctgcctttggcctcccaaaatgctgggattacaggtgtaagtcactgtgcctggttttggaatgggaattatggaaccaacataaaatgtttaactctgatgagaaaagtcttatttttggaattgagtcattggctctcacgataagcctaggtgaccctctaggatttaacttcttggctgtctcatttgtctcatttgcacaaatctttctcattagacctatttttgtttgttggagatcaggtaaccctggagtgattattttcccctggattttcctctattgcggaggaattgctttcccaccaataaaaagtgtcttctggagcttaaattcctggtgtcttgagggtactatagagcctcttacttacccagtctacactagaatccatgtggtcattaccatcctttgattgcattttgtatctatacacatacagttcagaaggcaatagatactctgttggcaaagtcatcttttcccatgggtagctcaaattgaggacaggaactaacttttatatatgcttatattgattgattgattgactgactcatgcgttcattcatttggttactcaatcagcaaatcagttttgaacatgtctttgtacctggtactttcctgggtcttgggtgacaagacttaggccagctcctaccatttataccttttatatggtctgtttcaagggcacaaacagagcccccagtcagatggccctacctttctctctccccaaaactacaagggacctcataggcaggtgcatggacagttcggcctacacacccaaactctatcaacaccaccatagacatcaaccttggacctccccctttcccttacactgctgtacctggtgtgtgcatatccatggcttggtgcaccctcaggaagatggatccaaggaaaaggcctgctcaggccgtaggagtggactcagggtctttgagtagggaattctgggatcctggggaagggtgaaatccaggaaggagcatcctattggctctgtggactccttgcctcatgtggaagcacttgctgaaggagaacagagtgatggactccaaaggacctgggcccaatgctcagggctaaaggtgccatggaccaggctgatcggccctttgcattgtggacctggcctctgcctcattgtgcttttgtgctatgacgatgatgctctggatcagggcaagtgcagggcatatgtcctgggagtgtgtaggggggtggccaggctcttcagatggttcctacacttcagtgccccaccctctcttcaggggctccatgttcccaacaaggacagagtatactggattcctccccatcaagttttgtgatattatcatagacacaagcagatcacaagcaaagcatagatctgtccccagcagtcaatgagaattgttaaacgtcattagctaccagcttcctcctttctctcttccccatatggattttattattgcccctgaaagttctgggtctaaatgtaatgtttcaagaatcagctaattgtggctaaatactattattttttactgggacccctggaggatcctgagattgtaaaaactgtgcctgaaaagttcctttcctcacgatgtcttttttcctgaattgaaaaattactgaatatgtcagtagacatgcataatggattgatagattaattttccattttctttgggagtttgtgtaggggagtgattcctgttgtaacattggtgggttaagggctccactaggatgtgtggtctgccactgctactttggactagtaactaaagctttcatgtctcagtttccccatctggaaaagtgggcaataatagaaaaatagaaaagcattactgtgaggttaaagtgagctgatgcatgtagaatgcttatagcagtgcctgacacacagttcgcactctgctgttagcttatatgtgtgcgcatgtgtggagctatcttcaaatatgattcagaggaaactactctgtgaggttgggaggactgaaaagcaaaagactctgccttgagcatgacactgaacagcctgaggctaagaggacagatgtaaatggcgctggttcccttatggcaacctttgcatgccctttggcttgtctgtgcattactctcatcgtgtaggacctggtgtgcttagctgattgggacattaaccattcgtgtgctgagcgatcacaagtgagatttcatgactgttattcaggtcattgtctttgttctgtgactttggtttctttgatggtcctggtctattttattggtcaggttgtttattaacagtcctcctggactctgggattgtcagtcattttctcttttatttttctccattttctcttttaactgtcctttttattctttagttgtaaggcctttaaaacatagacatcttatcctttttttaaaaaaaagaattgtagtgaaacacacatgacataaagtttgccattttaaccatttttaagttcatatttcagtgatgctaagtacatccacgtgttgtgtaaccatcaccaccatccatttccagaactctttacacctggaataattgaaactctgtacccttcaaaccatgaccccccataaccttacctccctctagtgcctggcaaccaccattctactttctgtctctatgaatttgactgttctaggtacctcaaaaatgtacatctttttgaacagtaatatatcccttgaattaaaagctttttttttaaataagatatttgtttaggacttttacagctattcatgctttccttttgcaaaataacttacttattgtggccttacacaaccactatgattggaatttctttccactagcatctttgaagtttaactccaaagaaagtaatctctagccatctataaaaatgactgaaggttaacatgagaagtgaaatgctgaagataaaatgggaagtgtccctgaatttcactccctttccttactcccatagcctataaaagttggctgaaaaattgtgccaatatcaaaacagaccttcatagagatcctaaaattttaccactggaatcattctcctctcttgacattatgctcatttttctctttgccatgcttgacctatcctgaagctggagaagaagtattagttccaaaaattttcttcttgtgaaatgatttgtcctgactggaggccaagagctttcaaaactgtgttctgctgtgattcgtgatgacttgaatgctttttagaattcttacagtccaggcgaatcattggagattcttcttcaagagtcataaatgggaaatgtattggcttgaaagaacagggaaagaggaaaagacattttaaaaaatgataatttattacaaaaaaaaacattagctgggcatggtggccggtggtggcaggcgcctgtggtcccagctacttgggaggccgaggcaggagaatggtgtgaacctgggaggtggagcttgcagtgagccaagatcacgccactgcactccagcctgggcgacagagtgagactccatctcaaaaaaaaaaataaaaaaaatgataatttatatgttagattgaagtttcaagattttactttttaatgagcattcattctgaaattttaataaatcatagatgaaactacttactaacccatttcttgaaaacaactagtatagagtaattctatagtgtcagcatattgtacataaagaccatttaatttttatggaatgaatgttaaaaatgtcacaatcagtttttcatcagtatttgaataactatttgaattataattattttatacaataaaattaataaggtaaaaatgagagggatgaaagaattaaagacaagaactccaactaaccctaatggttggcatagttgctgtaactgagtgcaacatttgtccccaacttcctggcagtgaaaagagaaactcattattaggaaggagaatgcctactaattccacaggaacacagatttgtctggcagtgtattccaaaaggaatttcttttgcaggaacaataagtgatgtaacgcacagtttttatgaaaaatccagaagtagctttcattttcttcttcctgagaaagccagtgaaagttggaggaagtgacaaggacatcaattctgcaaggaggctaaagttgtccaagaatttaatctcctatcccagggctgtaattataacactgatacaactcaggatgttagactcccattcctacatgccctttgctgaaccaggctttgatggaaactggactgcacatgatttgaagttgtctcctttgacaagagcctggaaaattttagtctctgttgctggttaaggccagatctgttctctttgaaaaccaaacaagcagatggtgggggctgacatccttttataaagaccaagcagcctggtctgtgtgcttgttcaggtggaagctaccctatctgagtatgaagatgagctgcagaggtaccagcagagatgcaggcttcctgggggaagcagccctgtgactgccccagaacttagacaaatgcttgattgaaatcccagagttccaccccacagagcagcagagaaggttttggcctaggagctgttaggagcaggtgtgaccagacggcctccccagccataggaaaagctcccttaggctcccgtggtgcctccaaccctgagagagatggtcctcttgtgagcctgccaggatgaattagctgcagagggcaccccaagtcgctgaatgagctgacttgtgtttctgatggtttcatattgaccgatgttagagtacatctgctccaaataaaaactgtggcttaaacgtcaacttttaagccatttctattttttggagagtagttcagtgtcatttttgtcctggtactcttcatggtttaatatggtaaattggtgccatggtacctgttcagttattgtcttcccatcggctgtcgtggattactgtgacctatgaaagatctgagacctaatgtaaaatatacaatgatattaattaaatacgttggaagaaaaaaaattgtcagaaaaaaacccatcccttgcttctcctgggaattgtatttaccattataccaactatcaaattaccttggctatgtctgtgcaagtattagttcatttttaacaacagaagaagtttgcaaagtttccagaacaggtaaaagtaacttaaagacattgtcaatttttaattgtagtttctgtgtcattttacacacagtttcttttcttttcttttttttctttttttctttttttttttttttttttgagacagagtctcactttgcctcccaggctggaatccaatggcgcgattttggctcactgtaacctctgcctcccaggttcaaggattctcctgcctcagcctcctgaaagcagggattacaggcatgtgctacccacctggctaattttgtatttttagtagagacggggtttctccatgttgctcaggctggtctcgaactcctgacctcgggtgatctgcccaccttggccccccaaagtgctgggattacaggcatgagccaccgcgcccagggtttacatacagtttctgtgtgctagtctcctggtagcatttatttgatgaggttcattttagagattgctatgcatgggagctctacacatctcctattcatgtaggagattagttggagcattaaagtctcttatgagcaagaattaaatcaggtgtcataaaatctttccatgggccagtgaaagatcggaagttgctcaagatggaaccaattggaaatgtgctccgaacaacccaggggcagcacagctcgtggttgccaggaggagatgctggttcagtttcatggaccttctgttttcttaagacaacatggaaattcaaaactttttaaatgtgaaaattttcaatctcaaatgttagtgactaattaaaattttctaaaaaataaagcacccttgttggtcagatcccgaccacgtgcttttgactgtgacctctggctgatcatcagttgctaagatttacccatcatgctacttgtagactgagatccagtcttaaacttgcattcagggctctggcaataagttaaattaaagttatcctttcattatagagacctatatgttttatgagaaagaaaatgttaagtttttttttctcatcataaattttggtggtccctgttggaaatcaccatattggtgggaacagataagaaaagtgctatataaacactcagagagaaatacagagtgtaatttttttctttataatattttgaagattttttctcataatttatgtattgaagagatgtgagatattatcaattcaaatttcctcttgcactagaggctgggtgacattaagctcaccagctagttagtaaccaagccaggccttgaaactggtctgttcattttaaataataattagcattaattgaaattctcatgtgcagtctggttttctaattttcccaacaaccctaggaggcagttactgtcgttactgcattttgcagacaaggaaactgaggcgtagggacttgtctcaggtcatatagccagtaagaggtgaagctagtgcagtatgtttagtcctcatcctacactaccaattattttccaggcactcaaatttgtaaatgcccggagtatttgggctgttctaataagctgcagttttcagaggcattgtgtaagaatctgaagatttcttatttatctcctattgttgctctatgtaaatataatacaggacatcatcctaaaaagtatccctgttcttttccattgactgctgtgtttgggctgtgattatttgtaaaggtccattgtgcaaaaactctagaaattatttatcgtgaaggtgctggatttacaagtccccagtcctagagcgtggtacagtggctatgggctcagacttcagaggcaggtacatctgggttcaaatcctgttttggcagctatgtgacttaggggaagtgatctggcatggcgaggccccagttttgtcttctgaaaaatgggaacaatcatagaactctcctggtagcattattttgttaggagacagtccctgggtagccttctggctaacaccagttagcactccataaagagggagttactggtgctacttcaaagctcatggccaaaaagaaactgaaagctgaaaatgccactgctcaacagcatgcagtagtaagctcttcaaatttagattttgggcttgctcatttagcgttctttccattcacgtcctcacagttggggtgcataccccctcaagaatagagccacagactgagagtctgatcttccgtatcacctgcacctgctcagggactgactttcaaaactctttctcagcatttttgctgagaaactgaaactggctagctgtgaacccagggaccaagggaattttttttttagaaaaggattattctactccctatgaaagaaaccttagagcagagagaatcctgtcatagttgaaatgccgtggctgtaagcctgggaatttgaggtctatctacttttatcaaatctaatctatcaatcaatcatctatctatcatctgtctatctagagatgatagatagattgatagatatcatctggagatgatagattgattgatagattagatttgataaaaatctatctattggccgggcgcggtggctcacgtctgtaatgccagcacttcaggagaccaaggcgggtggatcacgaggtcaggagatggagaccatcctggggagcttgcagtgagccgagatcgcgccactgcactccagcctgggtgacagagtgagactccgtctcaaaaaaaaaaaaaaaaaaaacacacacaacaaaaaacttctatctatctatgtatctatctattttattgatctatctataaggagggaggatggggtagcaggaaacgattccactttgaagagtcaccatttgaaatattcacagctgcttccatttcattttgatgtgttgccaaagtacagttcaggtaataaagtctaggctaaaggggaatttttcttttgagtaataccactattaagctaatatgcttaaagacaagatgcattagatactactccttgttgcttgaagagattacctagaggaattatttgataggttgttaaagcaaatgtgaaaccttttaaaatgtaatgaggaccctttccagggaacctgtaagtcaaaagtatttctgtgaattttctctaaaattacctcttttctcttattttccaaaaagccagctataagctttttgttaagccaaagaagaggaaattctttaccctcagaaaaatgtcttagtaaaggtcctgaatgtcaaattgagactggagaagatttggtgacaacacaaaacaagatgacaaatagcatgtactgtgtttatgttctaattctttatccactttccgatcactcttcaaagcttgagctcaatgccctttctccttttaagccttcactgacctgcccaattatttaaatatatataaacaaatatatatttccaataatttttgtagttccttccactgtgccctcacagggcaagtgcatgtacttcttcttaaaaccttttctttttggctcatcatatcctgtggcagtgtccactgtctctccttagagcatcatctccttcaagataaagaattgctggatttgaagaatcatggaggccatttctagtcttacattcctcacatgttggggttctgtggcaaatgaatgcttatctgctgagggcaattattattattattttagacaagatcttgctctgtcacccaggctggagtgcagttggcgctatcatggctcactgtagccttaacttcttggactcaagtgatcctcccacctcagtctcccaagcagctgggaccacaggcacctgccaccatgcccagctaatttttaaattttgtgtagacagggtattactatgttgcccaagctggtctcgaactcctggactcaagcctcctgccttggcctcccaaagtactaggattacaggtgtgagccactgtggctagctggtttttatcacttaaataaataagtaaataagtagtgggtttgaatatgttgtgttcttgtaatctaaattagcttttagattggacaaatttggggttccaaatcagctttccacccccttctgttattgtctttcctttgtttgcttgttttctgcatgagaagtgaagctgtgtcctatgacggtgataaactccaggtggaggatcagtttgggtgccctaagtgagcagacattccttgagcatcagctctgtgctaggaaacggagatcagtgagatgagatgaggagctagcaattcagttatggggtcaggtagactcatagaaaaataaaattgagggtacaaagagtacctcccattgctctaattcttaattgcaaacttacaagtgcaataaatgctaaaactgcatgccaaccgatggaataaaaatgttctgattggaaaaagcatttttggtgttgtgtctacaaatcactcaagcagtcgtggagggtcctgggatagatttagatgagtacattgataagactctatcatataagatccaatctttagggcaatagttaatgaccttgggatgtagtaaatgtgcaaaaaataacagcaaaaactgccctcataatatgaggtcctagcaagagtcctgtatatggacttggtaagggaggaaggcacattctgggcagaacaggatggttgaaggccaccaatgattcctggcagattattaataaaggttgagggccagggaccctgagggactgacgaggtgagagaaattcctaaggagtaccaaatgaaacaaaaaatccgaattcaccatgcctcttggtcactatttaagggccgctgacttgcctaagagagcatgcaagcaacgtctgcaggctggggggtggagggaagctcaattttctgagaagatgaaaactccgtggacctcgtgagattcctgtgaggcaagtgcggggacatgggctctgggggcggaggggctgtgcttggaagcccctgggcctaagctttctagagcagtgggcctaggttagaggagtttgaggttgtcatggagagaaatctcctggttggggtgtgtgccacaattctgggccttcccactgctcccttgagggaatggcaccctttttggagatgtgttttattaagcagagcttgactcggtgaagagcccacagtgtcactgcactttaacaggggcagtggggagtggttttctgggaaagagcctgctgcccgcctgtcagtggccctgacctggcacttcctctctccttcctaaccctgtgcctttgggatcagttgccctgaggcagagagcaggagaggccagggctgtggagatcctcctggaggcaggtggaagtcaccaggagggggcagcgcagcacacaccttggtcttctgtttccatgcggaggctgtggagcagggaaagaaagctgttagctgtttgctgtttgggtggtccagggaaccaagaacttgagctcgggtgtgtttgtccactgagtcactgagaaaccctggggtctggctttcctgcagttatttcctttgtatggttgttgcagtctctgtctctctttctttccctctctccctcccaccctttcttgcttgctgtctctttcttttcttttttcttcataaattttaaaaattcaaaaaagtataatgacataataactttatataattacattcagaaataatagttgaatatttttaagctattttttcttttaataaaatagtttagcagtttaataacataaatggtataaatagtttctgtgtatgtgtgtgtgtgtgtgtaaccccagacccattctcctttcccaaggccaccttccttggaatcatctttctatacttggcatatctacttgactgtgaacactatgtgatattattttttgtgtatttttaaaagttcacacagattgttttatgttacatgtacgtatcagtatacaattttgcttatcttctttctcacttcgcatagcagtgtctttctgttcaaatatgtagatctgatttaatctaatatatatatatatatatcaccttattttaaacaatgtctatttctttatggatggacactcgggttgttccagcttttgactctatgacaatgaatgttgtaatattctactgatcatattacaatgactcttcttgagtccatatgtgagaacttctcttggatgaatacctggaatagaattgctgggccctgaagggttctgatttataattttccaagatacaggccaagtgcttttcaaagtagttataacaatttacacttcctccaacaatttcagagaaatttcatcacatccatagaaatgttttacattgttagactttaaacattttgtcaatctagtgggagaggaataatatgtcattgttattttaatttacatttcacatttcttgggagataagcaacttttcatgtttcttggccaccgaagttttccctctgtgaattccctgttattcaccttactggcttcttttctaaccctatgatttgattcttcacttagtggtagctaaggagagtttcttagggggtagatttcctgagcagtttgtagctagcatctatattgtggacatgactacacgtagtagcttatgagggggaattcttaggatctactactagaggagcccttgctgaaaattttttttttttttttgagacggagtcttgcactgttgcccaggctggagtgcagtggtgtgatctcggctcatgtcaagctccacctcccgggttcacaccattctcctgcctcagcctcctgagtagctgggactacaggtacccgccaccacgcctggctaattttttgtatttttagttgagacggggtttcaccatgttagccaggatggtctcaatctcctgacctcgtgatccgcccgacttggcctcccaaagtgctaggattacaggcgtgaggcactgctcctggcccttgctaaacttgtaatccagctcttctgttggcctttccatcttgacaagaagaaaaatgtatttatttatccagggcattcttgcccccacagtagaagcgtattctctagtgaccatttttcataacttcttttgatggtgcttttgaatggttttcagcaaaatttcctgtctggtcttagatttcagaatagtggtgctttgcttaattggctcattttcatctcatgaatactgtgaatttaccattgaccaaatttatcctcatctccttctttcttggacactggtgactagaaagcatagaattaagcttatgtgtgtgtttttttttttttctaacgagtgtatgcatttctaaattgaattccgggctccgttgatatctctttatttttaatttatttttatttttaaattgttttttttcttttttttcccacatagttttgtgcaatccattgacatctctacccctgtctttctctcctctatgccttccatttttatttgctggttcgttgtattctattgaataaaaccggggagtttataaattaaatgtctgatgaaaaatgaaaagaaagggcataagtaacaaaaagttaaagatgagtgccttgtgcagatcataataaagtccccattgagttccaggcccttgttgtgagcatggaggatgcaaggataatccaggaaaagagtgaggaagaactctcaatgacttcaggacagtgacaggcctcatgcttacacagctggtaggaggggacaggcttgcctggaagtctggattgtgactccagaggaaaactcgcccacattatctatcctttttgctgtcagttgcatgagaaaaagtattaaaattcagggctctttagaatgcagttcttactgtgagatcatttagaagagtgaggtcactgtggtctctattgaaaatgttggtgaaaaatcttgcaaaaatgtatctaaagtatgataactctgaaacagttgatgttaaaaattgagcattcctttcaagtcttaaaatgtttctttcttctatgtgtggtgggaggagagaagggaacgaaagcttcctgcacatttattaagtgtgccaggccctgggtatcagggacaaccaagaattttttcagaagaagccgccgttctatcttggaggctggttttttatgtaacaggggacaatgtttgtgtggatgcttttaaaagtatttctctttggtgtaattttgtcttctcagagaatctactgatttttatttttaaaatttattttctaaaaagaggtgcccaaacccttactatacagcttgtcatcattttctttcacacagtgggggacctatagatgctgtgtgttcctccccatcatttaatatttttttcattttaactcacattgttaacagcagggctgcatatttgttttcagtgtcttaattggaatatgttatatatcttaaattttttcaaaaagaaaggggagatttcctcctggcataatttcttgtaatgcctttgtaactccaagtgcagttcatcttttctccatctgtccatccatccgtccatccatccatccatccatcctttgagtacctaccttgtactgggtactgagccaggtgctgtgatgcatattaagaattataaaacagatctagctatctcaaagacattgtgatctaagaaaactgaatagacaggtacttaaataactgtagtacagggtagagtataggaaattccatgatgatggttttaatagctatttgtttggatcactagggactttactgattgcaaatgatagaacttaagattaacttaggttagtgacatctagcctgagagacagttgtatctaaaggctcaagtggtatttttagagttctgtctctttagctctgcttctttctgtggactgacttcattcttggacagtctatttccttgtagcagaaaatttccccatggaagccccaggcctgtgccatccttcagctatgatcccagagtaagacagagactctctcttccccagcattcatttatttaatctcggggaagactcctcttagtgtaattgagatcatgtgcacatctctaagcccaccaatgtgggcaaagggatggagttttctctctattcacccctatattggagggcttagggggtgggggagggaggaggttcccacggagaatgcgctaaggccatatggggtttgtgaaatgtggttcatcaaaggaaagattgatactgttactgacaaaggcagaaggaggagatgctgggccaggaaaatagagagaaaagaggaaggggtagggaaaacgcaccttagtattttaggaggtaaaggagggagtggctgtctctcttgaaatgtggggaaatatgtgacttttcttgtgcagtgatgacagcagcatctctgtggctctcaccgtaagagtggaaacacctttgagaggagtagatgcatttccacggtgttttcacatatgtacactggtgatactccaaaagggaaagaaaagtgaaattgttgggtgaaagagtgatgaaacacgaggagaaatgaaacccagtgcaagggttattgaccatgaaacctggtcagtcatggtttctgctcagtcatgctcagttttgctctactgctgtatttaaaaaaatggcaaggctcagagtggtgtggagggagcaccttggacacctgggtgaggtggatgggagttcttcatggtgctgctgcctacattctgagtcactgcgattcactctctgctttgttacagtttcatcgcaaaccagaaaaggttagaaatcatcaacgaagatgatgttgaagcttatgtgggactgagaaatctgtgagtactcaggaccagggcacattatctcagagaattttcctgttgtctgctctggtcaggcaggcattcactggttcgttctaatgtgcatgaaattatgtgttttcacaggacaattgtggattctggattaaaatttgtggctcataaagcatttctgaaaaacagcaacctgcagcacatgtaagtagagattgattcttttgcttcccaggacccattttattcaatatttcccccctctgtttattttccttcttttccaacttgaaacctccctttttaaagttagtatagctgtgataatagcttagaaacattagctctgattttgtttgattttttgaatagcttcagaggggtacttagaacaggctgtttattccctttcatgaatttctgggccagttccatcttggacagagcaataggctagcagcaaggagtctgatgtgaaaactgtgtccttgcacagagttcttgattttcttccttggaataatgacatactccctggaagacatcaaactagtggaatcgaaagaagctgacttggccttggcctttatagggaaataaaaattactggtgcttttcccctcacaataggattctcttttgaaccttcattttcccaaagccgtctgtcatggtttgataaaggtagagaaaaatcaatcatgggacatgccaaaggtacagaaaattattaacaatgggaaatatttccccaaagtcttgttgatgctttgtccactgaagtcaaacggaaatatggaaaatgggaactgttagcttgtttgttgctaaatcctctagatgatggcatttaagtccataaggtgtggctttcctgagagttgtcttcattaaactaaagatcacctaagtgcagaatatttatgcatcactgagctcagacttgtactcccatcccctgagtttttagtggaacttctgccagaaggttgttgcctgcatttattgattctgttttgctgtaccaaattctctttgcagtgataccttacatgtcatagtctatctgtgggaccctcacctggattatttcacatgatttttttctgacaattggtaggacagatcttttttatgcacatttcatagataaaataagagtgagagagttctaggacttgctcagattcatagatcgtaagtagcagagttatgactccagggccaacccctctccatgttcttacaataagagcacaggaaataaaatctgtatcatccttagagaatcagactttcttataaggttcgtcctctttctttttttttgaggagaacagttccccaactgatttccatgccagttataaaagaaaccattctcttagaagcagattgcctggacactctattgaaatttgttgatattatggaaaatattaatttcataaagccaatatcatagcttcatattttataggtggcattaatgatgaagtcactttaaaaataaagtctgtaaattaagacataaaacattctacaaaaatgtgataaaactccagggaactttattaacacatttcaattaaatgctttttggaatcatttttgcagtctgcacaaatctttgcctgcacaaatctgatggctgcataggccttgatagcataaacaagagagaagttggatagaagaaaaaggcaaaatgctctaatgcagtcacttagatgtaattaatgacctcagtggttaagttctggtattttcattacagttgaccttagacccaaattactcaacaactgcattttactggctcttttatcacatcacttctcctaatgttgtgatttggacagtgggctctggctaattatagttttattaatagacttactgattactttactttgtatattttcattattgcatgctatttctatgaatatgaaagccactttgtatattttttcatgttgatatatgacggtgattttggtggtattcttttttttttttttttttttttgagatggagtctcgctctgtcacccaggctggagtgcagtggctcgatctcggctcactgcaagctccgcctcctgggttcatgccattctcctgcctcagcctctccagtagctgggactacaggcacctgccaccacgccaggctaattttttttttttagtagagatggggtttcaccgcattagccaggatggtctcgatctcctgaccttgtgatctgcccacctcggcctcccaaagtgctggtattacaggcttgagccactacgcctggccggtggtattctttgtgcagtacacagcttatataaagtcaaatatctctccctagctttcagagaagaattattttaaaatgggaagctaaagggacatacatatcttacagttttctgaagaagcaattgttgggatgtcaatcattgatcaaattgcaaaaatgctactaatatttatagccatttattgaatagtaagacagagagaaataggcaagtgccaggcagttatgaagaggtcatcagatggcagtaagcttcatatagtcacaggacaaaagaggctcttaatcaccaaaatctgaaattaaattaagtagtttgcttttgagaacagtagggaggaaggaaggaattaagtcaggtgtctgcctttccggatcttagacctaacctctgcttgtgatggaggactctggggaacagcttggttggtggtcccctgattttccacatgcaaattgcactcttccctcaaatatcaacgcagtggggtgcaagggagctgataacaaaatatgtattaaaagctgtttctctctacccctgggatatactgatgatctctctgagtttccccagcaatataaaaatgcatacaagatcagtctatttcacttcgggttttagggaaatttaaatgggatcctctctctcactttcaccacttctccccctaccctgtccatgtgagcatcacatggggactgcccagagccccagagactggtcactgcgttatttcttgatgcctttaattcctgcccagccccttagagcccagggactgtgagaaaagctggtatttgtgttttccagggactttgcagaggtgctaattagctcccttgcaaagctctataatcaaacagtaagaggattgttgatttttttccctcccctcttcctccattttggcttttggccccaataataagtatggctcataaaactcatcttgttctttggccggtaaccccgctctttgcggtgctgctggcagccccacagaggcagcagctctgcggggcggcggttttaccagcagacagggagacccttcaccctaagcctcctctttctttgctgcctctctctgcctttttcttgaggaggaaagcaggtttttggtttttcgtttgtttgttttagaaagattgggacttctgatgaagatgaaagcattgtgccttagaaactgtggaagataggcagactgacttttcaatgcattgtataccagtgaaacccattcttttttttttttttttttttttttaaagaaggagtcttgctgttgtcgcccaggctggagtgcaatggcgccatcttggctcactgcaacctctgcctcccgggttccagcaattctcctgcctcagcctcccaagtagctgagattacaggcaggcgccaccacaccaggtgaatttttgtgtttttagtagagacggggtttcaccatgttggccaggctggtctcaaactcccaacctcgggtgatccaacagccttagcttcccaaagtgctgggattacaggtgtgagccactgcacccggccaaaacccattcttaattcacgttccaaaagaagagacctatgtgggcacattttacaacttcctggtggattatttttcatgtgggtgagcactttatactcagtgtgaagagagaagatgcacgcctaggaggaaggacggtacccttgtgtaggtaggggtttggatgagtggagatcttaatatagaattaagctgggagtggacacacacattcatgatttgtgagacaccagagtggtaggttctttcttatcaactgactagccttagttcatgctttagctcctggttgtaatgccaggactgtgtgactgatcaaacacactaggatacttcagtgatgacttccttgggctgacggcaaagagtagcctcaggtgaggggccaggatcactgtcaccctcagatctcatgtgtgttattttttgtttttttttttttttttttttttttgagacggagtcttgctctgtcacccaggctggagtgcagtggcacaatctctgctcactgcaagctctgcctcccgggttcatgccattctcctgcctcagcctccccagtagttgggactacaggtgcccgccaccgcctggctaatttttagtattttttttagtggagacggggtttcactgtgttagccaggatggtctcgatctcctgacctcatgatccacccacctcggcctcccaaagtgctgggattacaggcgtgagccaccgcacctggccagatctcatgttttatccaactctcaacccaacacttgccttcctcggcaggaaacacacactgaaagtctcattgacttcctccggtttgtagaggtcttggctgtttttatgaaagttgatgtttattttacattcattttatttattaaacacatcttgaggcccaagcatcggatactctttaaataaatttaaacagtaaacaaattcgcagagtgagtcggctgccagggttatggctctgagtttcctaccccaaaatctcatgacactgatcattggaaactcttttatagaatcaaattacatgtttggaacatgtcagtaaattattattttttttagtcacaaatatatctttttattgtctggttggtctaaatctgaagatggtatgtcactagaatggttcaagatgaaatctgacatattccttgttacctaatttttgtttgttctcatcgtggaggtatgcggttatttagatcatatgtaaacaatctcagtagagttttttttatcaataaaatgtctttcctataaagacgtattgaattcagttaatattcagagttttgtatgccacataatttcaaaatatccatgatgctctttagttttaaggcatattttttccctactgggtttatagttttaaattttatttaatcttacatatcctcctattaattgttcaaaagatcagggtttctataagatatataacttggctccaaatcaacatatgaaaagtaagcttttgggtgaaaaagacattaaaaatacacaatatatttatgctacccctcccagcaaagaaaaaattatagacaaggttagaggaaaaactcagctatcactctaagtgaaagagagagagatctggatgtaagtaaagcttatataatgatcaaataaaattatattttgaaaaacaaatctctatttgaatactgtgttcctaaaatgtaacattttaaattcatgtttaatgtttttgattcctttcagcaattttacccgaaacaaactgacgagtttgtctaggaaacatttccgtcaccttgacttgtctgaactgtaagtaatgattttgtgtggcatttggggaaatgttttcaaaggaaggggtaattaagtatttttcttttaatgagtgatgttgcagatctatttttataccaaattctcaaaaaatgatttctcaagtttcagtctctcagtcttttattccttcaaggtttattatctctcatttttaaaattcagtaattaaaaaaaatagaaatctcagtagtgacatatcatttctgattcatttaaatgttgattttacataaataatttctggtacagggaaaaaagagaaaaagaagggggctttgtgtgaaaacggctgtatgctttatatctcacagctctggtttggttcctgttggatccaggccctaaagtcaagcaaacccattcaaggaggaaataaaaatgggcaaaactctgctcacttttgtccatcttaaggataggggacattggaggagaggtagttgttctctctccccacccatctttgtgagattttcttccagatctgttattgcattcaatatttatttttaagtcccattttcttctgttgtaaaatgatagaaaacgtattgaaaggtgttgatgactaacagccaggatttccaagtgagctccattccttgcattgtccccattaaacaaatatgaactgttgctattcttatggtaaggcacctcaaagcatcctaatgcagaggctttgtggggcagatgtgggcccaggaagaggcctttgaagattaggcaatggcatttgcttaaactctatgttgcctgaattgtggagtctttttatgaagatccatccttattcacaaggaaattgtgcagattggaagatgtcactgctggagagacaacaagttaataggtgtaatgggtgttatatggtgaaagtcttggcaattgagaattatttggaataaagtgaattcagggcgttgaagcactaatgcttctaacacaggaataggcatgacaaactaaaggaagatacatgagatagggtaaagtacttggtgtaaaaattttgggcaacattgtgtaaaattttcttgctggattaaaaattagagtttcaatttcaaatttatgtctcaatattcttcttgaagcatatttaatcaattaattcaacaaatgttaattgtgtacctattacaaatcaaaatgatatggcacagggccatggggataaagggagaaaagtttctatgttcctggattctgttatccagtgggagaagtagaaacctaaagataaaagtgtaatgtgctgtcataatcatcgagcttgcatagtaagctggagaaagaagccagctgtgcaccagtgttgtgttgtcatatgaacattgctgtattcataattgaaacattcctttccttctttatcccttctgctgagttaatgatatcttcttttagaaagactctttagttttgcatgtactcagagctccaggaagcattttggattagtggggtttaaactggtggtgggtcttttctgcattctattccatatctcataacatcaaatcccattttggtgttggagggatacttggaggtgatcaagcagacacaaattaaatgagtctaccatgaccacattttcccctaagaaactcctggaaaagtctccagggatccctgagattcttagaacccaaccagaaaaccacaggagtaaatgatgttgcaaagcccaggtcctgtcttcacggaaatcttaagtattgtggttaatgccaggcagagtctatgtaacgattttaaatggcctcatttaaaggctcattaccataaatggaattcatcttaaataggccactgagtattataaataagcatttaaagatttttttttccttgtggtttttattttcctcttgactacttcctcttttacccattgcaggccacaggagtccaggcagcatggctgaggtctgaatggcggtggctttccacccacagtggtctaacgcagctcaatctgcagctcagttgccttgccctcagaatagcttgctctgtgtgtgtgtgtgtgtgtgtgtgtgtgtgtgtgtgtgtgtaaggaggtctacagcttcctttcaggttctctctctcacctttactccagctatcttgaatcaatgaaactgactgtgattgtataatgcagaaagctaggggtgccagccttctggcattcacaatttagtcttagctttgtacttacagtctcattttaaattgagatgaaattgttctgccccctgctgaagtttgagcttagaaagtggtaacacttgagcctttagcctggtcagaaataagtatgttagcattcctgaaaacttcttgttggcatccttttaataactctataataaccatgataaatttgtcatggcaccttattttccccatgttatgagatgttcttttctatcctatattttggctatttctgtctctatcttgtttcccctgttattctgtaaggtcttctatcattctccagtgctgtctgcatataggagatgctctgtaagtatcagataaatgaaggaataataagtactgtcatgctatgaaagtggtatgacttccaagcattgctggctagaaagaattcataatgttgtagtattttacaagcactaatgtagctaaaatggaaaaaggaacttgatctgttgtcatttttgttccctgtaggatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtaatttatttttaaatcaatgtgttctagttgctattaattattctcattgccttggtgcggtagtctgggaaaattaccactacctggattgtatatagtattctgttgatgtctccagtgactcagacaacatttatgtgcagtgtggagtaatctttgcaagtagaatattaattcagagtggatggctgtaaagtgcatagagaaaaagtacactgcttattctttttgtttgtttgttcatttgcttatttgttcatatttgtttttccatctatccatccatccatttatccacccatccatctgtgcaaaaactatctgctaaaagtgtggcacttctctggccacatatacccttggatggcacccaggccaaggatctcagggtgatgaaagtgtcctggcagcacaagcaaatccaattcaatccagcacattcccttaaacttgtcttactgccagaggtctgtgtctcttgatggggtgccccaagtctgccatgccacgtgcttctccccatgtctggatttaagatctcctactttaccgtcatcccctattcctcttcccagcgttttcatctccaacatttaaaagggcaccgaatggcaaaatcagagctcatgtgagtgctagtgagttataaggaaggaatagcaaagtgttctgcttaggattttactagtcttcagtgatgtacctctacaatacccacacatgcatgttactaccccattgacatttgaatcggttagtcaaccagttaacaagttcacaaacaattatgtttgatcttctggcctagtggctggtgacacagcagaaagccatgtagcacctggttcttgtgcacaaggaatctgtgtattaatcacaaacaaccgattctttgttttcggaagacgctattatttgaggtctattttttatttaagaaaaatggagctgctgcacacgctttgtaggaatgcgataaaaataaagatatgagtctgtttcttaccctgaatgaccttagaagacggccctgacccttcccacagatttttctgtcacaaatagagtcctttggtttcataatgggggaataaggctttattctcttgccaacctctgtcagttttctttgctagctaacacttaaaaaataaaaaaacttttaatatgtgtcttttcctgattgataagagggtaactgttctctgttctggtgcaaatttgtactgctgagagaaattgcctagagggacaagaaattcaatgttgagtcacctggccttttggccagctcccaaatccccatggcagttgtggccacattggttcagcaaccactgagaggaaaagagagaaagcatctgactcttgctctgatttcacaaactgcctcttaacagacgtctgctttgtccttgcctgaaaccaatttcatttttttccattgtaatttttggttgtgttgtcttggcagcattccgggaatgcaccccgccttacgtgttattgctcggccattgtgattgggataggggacgtgtagggagtgaactggtcctcatttttcctaaacagtttgtcaattttcagtcattttttatttctgttttctacaaattagtcaatgaattgtgtgtctaagagtgaggttttgaatctactgtaatgagggcatgggctcaattgatcgattaggactgaatggttacattcacggtaacattcacaattcatttcaatgtcaaggatgcttttcaaaaagcaacattatagaagagtgtggcaagtgaatcgacagacttatttttcctatcgtttttgtgttcttaactgttttgttctttcccttttaatttttattctctttcaagtgttttactttttataattgcatgtattatattgatatgtcttgttgcaaaagtaatttcctacattacacatatgatgtttgtctttttcttgcctaaccatttctcctaaccatttcaggtcagtagtcatagatctgtcatattctttttaaccattacgtgaaattcatgatacaatgtgtcttaattaattaagtgttccatattgacgagcattttgcttattttccattttttcaatactgcaaaaatgtttcagcaagcatccttattcatgctttttacacatatgtacaagtgcaaaggtttttctagaatacacagaaagaagcagaattgttggtttatgtggtttgcacatgaaaaaatggctgtatctatttatgcccaccctaacaaggtataccttgatattagcaaacttgttagtgtttgtctttctaaaaactgctgtcatggcttttgagtttgcattttcctgattactattgagtatcttatatgtttattggactgtgtttatgcttcagtaaatttcctgtttatatcctttgtctatttttctgtagggtttttctgtttctttactttcattgttctttgttttttcttaattgtttgaaagtgataaatattctctttttaaaaaagtctataatactgaaatattttctgcacaaatttaaatatgtattttctgcatagagataaccaccaataaggcagaaaaaatatttttgcttccctttacttctcctcccagctctcagtttgttatcatctgggattttatttttgtattgttacctggcttttttgaagatgtcatatttctttgtatatcatagacttttgtgtcttactgtgttcttttggtgtgattgttctttttgctggagtatatcttctaatacttctttcatagaaattaaaaaaataaaatcaagttcttgggtggtgggaaattggcctgtattttttcttctcagtggaatttgctgagtaaaaaattataggctcaaaaactgagaactttgaagatattgcaccatattctttttgtattgagtgttgctgatgagaagtctgaggtcagtctgttgcttgctctttctaggtaaactgtgctttttatattttttcccctctagaggttttgagaatttactccttatccatgttattcttaaatttcaccacaacgtaactagatgtgggtttttttttttttaattctgcttattgtgagggataccttttcaatgtgtgggttcatgtcttcagttctggaaaatttttcttattgatttgctcaatgtattctttccatttattctttcattcaggaatcgacattggatagatatttacacttttggctccacccatgctggccaccctttccttagtagtttccatctgcttgtccttgtgtaccgcattatgggagaattggtttgctcattacttagcttttcagctgtttctccagctgctgattttttttcctttcaaccactgatgatcaatttccacaatctctcgtgagtcattttttttgtgactgaaatgcccttctccatacggggtttgctacatcagcagggagtcctgcaatcctgcctctacttttcggtcctttgaaagcctcactattttgtgaagcacatggttatgtgtccacttggggctgtactgcttttcattaatcctcttctgctttctctcgcttaggagttctttatagtttcttctccatcagcgatgtgccttctcactttccaactttgttctgggttttaagaaaaatattgagtatcacttctggatatctgggataagaaagggagccttcactttggggcttagtcatgtattaattttcttttgatggtttcccaactttggttctttcaggagaagttataatctagacagaaaatgacactagaatgttggatttaaattctctggaattctgtgttgaagaaaccagataataacacgccaatatcttcaagttagataagtcttcaagtcttgtttgaaaaaaatgaatttatggtcagctggctttttcttttacatatactttaaaaacacatctgttgtgtttaagtcacagatttgaagttcatcttatttccacactttttttgggggtaaaactttttagctaactctgaatcagtgaagaccatggtcttgtgtgtgtcatctttgtaaaccaacaatttgccaactactgtggccattgtatttagtttgcaattggtactatttttatttcaatgaaaaagaagagctgctgagattttatttgtttgtaagatgagttttctttaaaagtttcccttgttagtatttcatcatagagatattatatggagaacaagttctctacattttatatgcaaatatgcatattccatggtgcctgctgtactccttgatcataacaggcatttgatgaaggtttgctgaattaacaaatgcatgaaccatatcatattaatgttcatattggaccaggtttttaatataatggtgtgaacgtttcagttaattaaaaataacttacatacattattttagccaaattattctatagtttagtattttttcattatttttgaaatttttatcttgatggcatttttgagagagtctcatttcttcttttttctttatatccttagagattaatcgagcatgatagatggggctgggaagcttaactgcatcattctcattaatagtgcagtcaaaatgcctcacaatatttttctaacagtcccctcctgctgtgaattactgtaaatttattcatgctgtaaaacaagtggtggttcatttcttcaaacggcccttctaaaccttagaaaaactttgttaattgcaaggcaagagaacattttcatataacatttccacattaattggaatagagaggtgctatgagcagtggttctgaagactgaaacagaatcatgtaagtgctggtgaagaaagctgatttggccaggctgtgctgattatcatctcgtataaaaaatctccctgctacttcttcaagtgtttctaatgaaattatttatcacgtagtattttctttttaatttctgctcaattcctgcacacttagatgattttcagcagttagtcttgcagtagaaacctttcagtcacctcccctggcataatgggattattaaggagaagtggatgttatattttaattttaaaaaatactatcattattatttaaatcttatctgagagcttcttcagcaagtgttaatagtacatgaaatgctctgtcttaagttgatggcaaatacatttaagaaaggcagtattcctctgggtcatatcaaaagaatccctgcacctattttactagtaactagttaccacacagaataatagtcccacagtgaatataaggtggcaattcacttgttggttgaagaactgtgcagttactatataaaccatccttaatggtcccatggattgaaatcagacttgcctttgatttccttcctatttattaggacaatttcagttttccacttttccaaccttccaacttttaatgtagaagcttttaaaggcacatcgacaaaatactatttatgatagtgaaggtcagttcacaggtgcccaggaggagaggccgggttccttgagataaattgaatttaatgatttatttttaagaattacttttggtttcaaccacagtttgtagcacatatgtctgtgtagcatatttgtacatactccttcttttgttcgtgttgaaccaagaaaatagactggtagtaattctactttgttaacactcccagattaaaagaatatgctatattaatgctctatgtggaagttagagtgatatgaaacattattttcttagcaacttagttggattggctttctttcctgaaaaccacacacaaaggctattttagtgtactgctttggtttaattttcttagagatcaggttttatctcccaaatcaagcaaaccacacagtggatcgttgtttttctttatcttcttagaatgtcaaatgaagttgtttttttctcatctgtcaactgctgtttaaatttttgtgtttagaagttatgtagtacctgtcactattgtgacatggctcacatgtgtttagaagtgcagtttcaaatttgagcttgcaaagtcattttgctaactttctgtcatttttcctaccaggtataaagcaatcacttctaaataggtcaggctcattttgacttcattcctggttgtggaatatagctgttcaggaggcaaagaacttggaagatatgacaaggaggtggaagggtagaggggaaggttatagggttttagtattctgttgagagagaattaagagataggtcaagtgtttatttgttttaagttctgttatgtgtgcacaaatagaagtgagaggagagaaggcagagaacagacaacattataatttacttgaatacttttatacatgtggaatgatgacccaacatgaaatgaacagagctcaggatcactgaagcaagctgaaaacaaacacaagcaagacctactggtgattactaaaaaatgttagtaaaacccaaccttaacccatcttatttgttgccaaactgggttaatccaaaatgactagagatttgtttttccttaagagaaagtgagggcctacacactttgaatgagtgattgaagcacctagtcaatttggtcaactctcaagaagtatgcactaataggtggaagcagagacatggaagatcccagcaaaggaggcagccagaatgctctggttaaggccctggacagacagatgtgggccagggccaaccccactgactagctatttagtcataatacttgatagccttaacttcttcatctggaaatagaaatattaatggcacctactttctaggatatttaggatgactgataaggtgataaatggaaaatatttaaaacagagtctagcacatactaagtacccaataaataatagctattactatcatcaacaagaatagttagatttaaatgtattttacatctgaatttaaatatatgtatatcttatattttgtcaaattgcttgaaatgaaaataaagccacaacaaacattacaatcaaagaactgattatgtactcaaatctgcttggggaatgtaagatcaatggaattcaaatggatttctttatagcaggagttctcagaacttttaattttctaatgtgcattgtgaacatccagagcttcttacagagcctccttctccttctccttctccttattcttcttcctcttccccttcctcttcttcctcctcttcttcctcctcttcttctttcttcttcctttttttttgtaatcttggatttttttccctctagaatctcaataaattagagttctataagacacactttggggaaaatttgatggacaactcaggtccatatcagatttaagaataatagttgtaggaacaaaagccctttgaacaattgcccgacacttatggtctaaatccctgtccttccaagtgtgttctgtggaacagagagtttgctagaaatgcaaattcttaagccccaactcagacatattggaaaagaagctacatctttaacaagataccctggtgattcatacacacaatagagttgtgtgtatgaatattcttacacacaactttgtgtgtaagctttggtgtaaagaaaagctttgggaagctttggtgtaaagaaagtcaacattttcactgcctggttgatgattttctgctgaggtctacaggccagtacatccttcctgaaggaatccagatcaagagacatttacgcagaggtatctgtctgcctgagaagctggtcatctccgatctccagcgaggttccccagagtgcaaaggaagacagctgtagggcttagagtcaggatccttttacagtagagctagcagctcttggaaacgttgctgggctttgctgtgtacttgtgctgatttcaaatcttgttaagccaagaagtagtgcctggcaaatggttgatcctgccttggctattcatgcttcccaattcatttttattgtgctaattaaacctcaagtggtatttcaagtacagattgttttttccattattgaatctttggccagcatattaacgctgtagaattaacatgagtcagatgcttacttatttgtggaagactttacatttaaaagatcaagacttggccaattttgctcagattcctttggaaactgcgatgacagggtgatacaatttctctataaataaaggagactcactcttctacagaatagacacgtaattatttttaaatgaaataattcctttatcaaggaatcataaataccactttatcagtggtatttatggtccatgatgaaatggatatgtacagctcgggaggtagtggtgaagaccctgacctttgagttcaaattctaggtctatatgtactcggacaatgttgaataatgtatttgacttttccaaaactcatatacttcattaattaaatgagggcaaaatacttatcttcaagattggttctaaggatgagataaaacaaggtactaggcaagaatatctggttcagtgaatgctcaataaatgataatattagtatcactataattaaatgcttttagagctgttaattatgtaagcttgagtttgaaaaaaaacccacattagattttataggaaaaattaacattatgacataacatttcctactgagaatctctttattttaacctttctctcctcagaatttccaaactattagatacatttataaaggtaggaaattcatcccatgggtttgtacttgaaatgccaaggtgggtgtctttaggcttcatcagtggggtctggctatggagggggtcataccttgagaacaagcaccatgacgggccttgactctgatggtcaccccagagtcagcagataaatctataaatatagaaagtggaagagtcggctgggcacggtggctcatacctataatcctagcactttgggaggctgaggcgggtcgagtgcctgagctcaggagtttgagaccagcctgggcaatgtggcgaaaccgcatctctaccaaaaatacaaaaaattagtcaggggtggtggtgtgtgcccattatcccagctactcaggagcctgaggcacaagaatcacttgaactcaggaggcagaggttgcagtgagcagagattgtgccactgcactccagcctggttgacagagcaagactatctcaaaaaaaaaaaaaaaaaaaaaaagggagagggagagtcaacaaagcacaaacacttgcaagctgaaaaagcagatggttgagtagtaactgacttaaagggtgagaatactggttaccaagttgacaatggagaaagccaaggggaaacttggtttatatggcagaactactacaatgcttagagtgtgagagtacagggaacaccaaacactgtattggttgaaagtcggctaagcccaggtgactgcacctctcctgcctcagcagaaaaccggaggcttaattctctaaagtggataaaacaaaggttctgagaaactacagatagagtgaggccatgggaaccataaagaatatgatggatttacatactgaatattaatatttccagacctctttctcctccaagcaggaaattggaagagcattatttgaataatttgaccacccccttcctcaaaatgatttcatgatcctgacatcaggtggtacctagtaaattggccaataatattgtcctacaatgaagatgacaattcataaatttgtgcgatgtttctagtaccccattcttaaagatgtatgaatagccagacataattgaggaaagcttataattgaaagataaacacaaaagcaccaaagagagaaagagaggaaaaaaatgcgaaaaacaaagctgatatagagaaaagaaaaattcaagaaatgattataaatatatgatagaaatcgtaagagacattgcatccatggaacaagaagagggtgctataaaaaaagaacactcaggaacaaaagaagggccttgggaataaaaaattgacagaggaatgaacaaccttaaaagggggctttaaaggttaatctaaaaaaactccttgcaaatagagcaaataaatgaaaagttggaaaataggaaaggattagagaattaaatggactatctataaggtccaacctccaaacaatagttctaagtggtaagaaagcatgtgttatagttatattggcacatttttttcctttcatagtggtacatataacggtgttgcaacctgtaattaataccattttaaatttgatgaaataaagtaagtattgcatattagatggttctggtgttagtaaggcttgcatactcataatactcataataatcttttttttttttttgagatggagtcttgcactgttgcccaggctgaagtgcaatggcgcgagcttggctcactgcaagctccgcctcccgggttcaagcaattcccctgcctcagcctcccaagtagctgggattacaggcacccgccactgcgcacggctaattttttgtattttttagtagagatggggtttcactatgttgtttaggctggtctccatctcctgacctcgtgatccacccacctcggcctcccaaagtgctgggattacaggcgtgagccactgcacccggccacatactcataataatctttatgtctccattgagacaattacagcacatgaaaaaatgtgaagacagagtatgttgaatgtggtgggggccatggggagggctggcattctgtgtgtaagcgagcctatatttcatcttccacagtgggaggtcaatagatactgctgaaacaggaaaaccaacaagtagcaataaagaatgatacttagtgatgagcagagcaataccaaaagaagaagttaaaagagatgaaatgggtgcctcagggaacaggaaatagtgccacatgggtaaggtgggactactgtttttcacacatagtagcttgaatctttttcgtaatttttatagaattatcaactcttgtgactaaatatttgatttttgaaaaacaaaattaagtatatacatatttttaaaagtcacccagattatgccattgacttcaaggagatttttcactaagtaagcccatttcttctattttgccttgacatgctctgtaataaactgaacagcttaattgtcatagaagttgtgaagaaaacacattgagaaaaacaacagactcatctaaggccacaaagttagtatgtgccaggtttagggtgtggggcttgtattacactctgttaatcattgttatatatttcattgccctgtataactctggctattaggggcttttttttttttttttttttttttgaaaccccatgaaagatgtaacattggtctctattggatgcttacgggaaggaagagtttggaagggggggtctcactagcccctgaaagccagatcttattggggaatcctctcccagtggtgggataaccatgaaatatagactgtacaaatcttattccagtctgatttcactaataaagaaagatggctttgccggtaagaatacatgataagagaaaggtttatccataataatgtgaagacgaagggtcagatattgccaggtgggtgggttaattgcaatttaacggctgttgaaaatgaatcgccttctttgacctccaggttctgatctgagttaatgatgtatcatagttcttcaagacatagctgtcgggtgactatagtcccaagcagagttcctgacaccaagagagggacaggctccactagcaggtcctgacatattgttataccctctaagacatgcctacgtgtaaaaattaccatgattcttatgcagtttaaagcagtgtccacactcagttggtgtgataatttcatgaagtgatagcagcatccctaaaattacacatagcttttgaaatataaaagtataaaaatgatgctttgctggactattaaaaatgtttatgaggttcaaagtttcatctgataaatacattctcagagtctttccaataaaaagaacttttcactgaaatgagtccaacccattttcattatattccaaacaagatagcaattttacctataatatttaactatgatttatataactttgaaactttctaacactgcaatagttcaaactgcctgtctttgaaaaatgctttgaaactacattttcttcaatagaatgagtctttcaaaatctgtgtctggtagagggttagatttgtgagagttacttaaagcaaaaaacagatttttgcaaaaacaaaataggtgcatctcacccttttgtgttcttgagcattagtaaaaaatggggggtaggagacaggaggaaataaaagacatgatgtcagtccttatgtacaatctctgtttatgtgcaaaaactggattagtaactgtagaacaggaaaagaggtggaagacagttctttatactagtgttcttgaaataaaaggttattcggcaataatgctttaagtaaagtgcataatttattttgaaatctaattatagctttttttggtttatgttagatctatgaagctgatcaaagtagcactttttcagatcaacagaaatcagtctcaaaaagcaattaaagattgatttttaaagcataaacagttttcaatttattgcttttattttgatactgcatttaactatttgcatatgcctctgtttacttttcttgttccataggtttgccatctgcaaatctggccgcacctaacctcactgtggaggaaggaaagtctatcacattatcctgtagtgtggcaggtgatccggttcctaatatgtattgggatgttggtaacctggtttccaaacatatggtaaggcttgtgtttggctgtgtcttaatagagagacaagagtgtttcagaatgcgagaatgtattaaacctagtgatgatcatttgatattttataaggctacatatagaaatttacaaagagtttttgatgtacattcactttctacttattcttaattaataaagactaatgcaggcttgcattttagttatgcatacctaagagagcgaggagtctctatatccctagtgagctctttgtatcatcctgaacaaagcgagtgactttccctgtggtcttctcccttggagggaattcagggatcaagtcaacctcatgcacttagcaattgaaacctagagaaatagaataacttctgatttacttcttcgcctgagcccagttcaggcagagaagcttttctaatgctatatatacatattttctctagttaggggaagaaaccccaaatcttgtcactttgggatcaatcctaatcaaggttatttttgtctgttaattcatttgtagaatgaaacaagccacacacagggctccttaaggataactaacatttcatccgatgacagtgggaagcagatctcttgtgtggcggaaaatcttgtaggagaagatcaagattctgtcaacctcactgtgcattgtacgtaatcagactggcatgtgtttttaatagcaaatgatcatggacgtacctacgtttgttgctggggcactctgggtgctgcttaaatttgttaaaaaaagtatatgcagtgttttgtgcatactctattaagaaacattatcagcctcttttactgttcaatttctgcttaataactcttgctcatgcatgttttttcttttaagcttctttttcgattttgagcttgtcattttgtgccttcctctgtcttttttctgatagaatatactttgggctggttgctccctctggttaatgttttagcttaaattttcgtaaatcagtttctaaaactttcttcctctataaaagcaatatgatgctttaaagttatgatacctaaagtatttactagctgttcacaaatgcctaattgtactgttgataaaataaaacctcattcttttgttatcaagtttctgtgagaaggtaggattagtcctacttaaattactgaaaattattatcaccggtagaaaacttttattattattgttttaaatttctgtatacattgaatctaagttcaaagatatccctctttttaattaaacataagtacattgtttttcagtattgtaactaatacaatatacattttgaaattccaaattatggcttttagcatgaaggtgtatattcagtaaaaactatatagacacttcacgtcattgtaaattctgagctggcacggtataaattaatgaggttttactctatttggattagaatttggatgagaaaaacatgaacatgcatgtgtgtaagtgtatgtctgacttacacacgtgtagacccatggccatagctggtatcaatatgctggttaacactcactcatagcacacattcagtgtgtgattgctggagtgaatgattgaaatcatcagctgtaatcctttatcattgttagtacaatcactatgcccagtgggtactaaactcataatttctcatcattttgacccactcagaagcctgaagtcaatgttatctccaaacatatgcaagcactttcaactgtatgtccttaaatcagcacctaacccaaaattcatttgagcatggtggaaggaatgatgggccctgggtgtggggacctgggctggtgggaggaaggtaagtgtggcccctgccccactgtggtccttgtagtggttggttcatagcacaggtctacaagtgtgtgtatctacacatgcatggaccttattttgtgtaatatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgtcactggtaactggaaatctttccgtaaattatgaaagtgaattgggtccttttatcggctttgcttcttcctaggtagtactgtgggaggatttacctgaatacaagtaagggggtaatatcagattacctgctttctattaaaaatatccaaacttgagtttttttctcagtttcaggttaatatctgtatggtcactaggctctgaaaaattgaccttatctgtcatagtttagacaaagagcagaagcaataaattataaataatattaacaactggctgggtgtggtggctcacgcctgtaatcccagcactttgggaggccaaggcgggtggatcacttgagatcaggagttcaagaccagtctgggcaacatgatgaaaccccgtctctactagaaatactaatattagccggtcacgatggcaggcgcctgtaatccaagctactcggaaggctgaggcatgagaatcgcttgaacctgggaggcagaggttgcagtaagctgtgatcgtgccactgcactccagcctgggtggcagagtgagaatctgtctaaaaaaacaaaaaacaaactaaaaatattaacaaccaagataaccagtgcagagaccccactcagagggtttgtctgttccctggctacaataccttagatttttttctcctcttgtttgatgaacacatacagtcaagaagcagtgcctgagagggaagggccactgtattaaacatcaggattcaagattcttgttccagatctgccttgctcagtaaccttgatgagctcacttaacctcattgcactttggtttcttcatctgaaaaaaatgatgctattagatctcaaaggtcttttccagtccttgattttgtaattaccaaagccagactacattaaaatgaacagatgaagcattttaaataccctcacttaggataagtactctgtttaaaaattctacttgataatgtttgtttccccaaagcataaagtgctttatatctaaagttgaaataatccctactctgtccaggcttagattggaccccaaacatttaaaagatctaaacattggcatctaggatcctagcaaaaatggacaacactatcatgaaatgtgatactttcaaagagtatttactattgacaatcagtaataaatgttgatttgttatatttataataattcatcatcagcagcaacatttattgcattgatcagtttgatctgttttcgaagttatgtgagatcagggcttcaggcaaaattttaaaagtcatttttgttatttaggaaagaagtgctatcaaaaagtattcattattttattattttgagtttttttggtgatgaatctgtataatatcaagatacagatattagaaaccaaagtcaacttcaaatgaactctttccgctgtcagaaatctcttggatctgtttggagctggttttcacttatactgaatagatttgagaaatgactgtaatgcaggggtcttaagtagaacagagaaaggagtctctctgaagctctctttggggagttacatccaccctgatgatgatacaaaatactgatggattccagagtttctgatgatgtgtttttctaagccaaacaatggttgagtaaaattccctatcaatgacacagacatctcgagatggggagaattctgagctttctgatgctattaactctctctttttcaatttagttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgagtaactgacacttttgtatgtggggagaagataaagtctatcattcacctgttgacaaaatcatgtatacaataagccatcccccaacctagtggcttaaaactccattatttagtgttgctcatggatccataggtcagcggagtggttttattttgcatgtatttattgtggaattcagggtcatgaagcagcagctacataggagatgtgcctgttatgataagtgtggagtgaaagaggacaactgcaacgatgtgaggcttcctaaggcctagattcagggctggtgcactggactgtctcttcagcttatctgccattggccaaagcaagtcacagggccaaagccaagttaaggggcagggagttgtactcctcccaagaaggtgatgaggaaattaataattttgaacagttatctgatacacactggattaataactactccaggatgcttgggtatcttatgagaaaagggttattattattatttccatcactgttgcaagtatttaatgagattttgtacccacaatggcaaaacccatgcaaaaccgcaagcgcaggaactgtgtatggttggctcgtgatgcatttaagatttattttctagcctcttacctaattcaaaaaggagaattctggtttctcatccatggatgagaaattagtgtcttggactgttttgcttacccgggctgactgagctgagtgattcttttattggctccggagctgttttcctaggagtggtaatagtgcttctctggccaaaggctaggactgcggaaaggatggctagcatcaggggtctactctgggcacagcaggagcgtgtcagtgtgagcttcaggaacagtgggacaagtgtcatgcatttacctgcttcagatgctgtccttcagtggagtgttcttacctactcagtctcattgcccaaatgcttgctaccaatgtggtggccaaggcctgtgtttggatgttgggagctgtacatgaatagagttcctcatcagagtagctctgagtcagtcaaagtcatgcaaagatgacttggtggagagaagggaaaatagaaccctggggagacttgtaaggcaggggctgcttgggctgcatgtacctgtgtggctcccagggcccccccaccagcaaaggtgatccatgcaaagccatctctgcaaaacaataaacaagaatgcagtccttctcattacatgataagttcctattattttgctcttcactagacctctttttaaatgcacaagcttgcttagtatattcaaaatgtgatttggaatatgtgtttgatttataaacagtagcccttcaggagcacataaaacaagcaatatttggatgcaaaacccagacacccctggctgttgctgtcttttccattaaatcttcctcttaattgagagtttagctgcttggctatggttgctgcagtaaatccctagcttgcagtgtgcaggaagtcatgtttgagggaataatagcttcacagttaaatccagagacactgatttaggacagtagctttttgcttgttcttacataaactttttatttctgaataattttagatctgtagaaaagttgcaaagatagtatagagcgttcacagccttatcacctcccccaccattgttaatatcttacattactttggtacatttgtcacaaatgagaaactaatattggtacattactaacaactgaacttcagacttatttgaatttcaccagtggccctttgaaactcttgggggcaaaacttgattcagagtgaaggtctgcagtgaaaagctgtcagaagtggtctgagtcttttgatatcaatgcacagtactgttggtgtaaagccagtagcttctgttttggaaaggattttgatgtctttccttttgaacatttctatatggtactgatatttggtagagctgaactcttcttatccatgtggcctcattttcattgatcatttctgctagtttttacttagcttgtgatggggaagaattgttttctggtataagaataacttggtgcttctcaaacattccctttaaaagaaataattatttataaaaaatacaacttaggctaaattttataaatatgtttcctccccttctttctttccatcttcttgttcatgaatttattaggtccttaaaatattaataactgctttcagaaaagcccgtttttttgttctctttaagtatttacttaagtgtcagctatcaaggagtaataaatgaaagtggaaatgaaggagacttggcccagggtgacagtggatataaatggccctagtgggccataaaccagtgtgaccgattagagattgaccccacttggcttgggaaatagaatcgttgtgggtatttatgagactcacaaccatagcacacagacaatgacctttcttagaattgcttcctttctctattaacctcctttaaaactaaagaaaaataaacaaatagcaaaaaaaaaaaaaaaaaaaaaaatccctgcttgtctaaagtactttccaagttaacaacagcaggtcaagtttggctttatattccattaatatttctgctattatcatatgataattgatgaagaagtttagctctcacaaatattttttataagaaatttcagctactttctcccagttgttttggtaagatcccccccttccctttttttatttgttatattggaagtttcccggcttacaaggaagcaggcagcctgggctcactgtgaagctagttgcatttccatacagagccataattaatgtgacatctctggtgtcgcttagcgtatgtgcacctcattcagcttagagcagatttctgctcgggcgcgctggctcatgtttgtaatcccagaactttgggaagctgaagtgggcagatcgcttgagctcaggagttcaagaccagcctgagcaacatggcaaaaccccttctctacaaaaaaaatacaagaattagctggatgtggtgtgtgtgcctgtagtcccagctactcgggaggctgaggtcagaggattgcttgagcctgggaggcggaggttgcagtgagccatgatcgtgctactgcactccagcctgggtgacagagccagatcctgtctcaaaaataaaacgtaaaaaataatttttaaaaaagaactaagatttccatgggatggtcattttgcttaggaacttgtttttgaaaagagagaataaagactattgaaagaaactgaagcataaataaaccaaaagtctccaaaacaaaaattggtgaagaggaatggaccaattggatgtaatgacagtcctcataacctttacttccgcttgggatgcagacactagacgaggtggcagacactctgttctctacttggaggaaggatggggaagttcgacctcaagacagcggcagcccagtccaagggggtgccagtcacagcgtgtgaggatgtgaggcaggcattaaaagagagcggcccagcaaaccaagatccccgtgtaatgtatcttgagagtgctgggccttgcagactctgccatttccccagccagcaggctaatgtggaaggacaggtgctagcagatcttcagatgtcagcaggaccccagacaccaagccagcgcccttccccatctgttaatcactggtagcctggctagtaactgagaaagagaaaagaccttcccagactccagatactaaatcgatcactttgggtcccacatttaagaattgaacttagctctggttagtttgggattgtgtttaaggcaaaaaatgcaaactttcagcttcaaaatgaaatctagaaaaccatgatgtttctcttccagcacactgaagagtacaacttgtgacaatcagactacaggagttttatgttacttttgttttccatcatgtctttaaaatcgattcagtatgagagatcttccctggttcccagaacagtagcttcctgccccttgttgcacatttgaatcaactggagactttttgtcactattttgtttgattacatttttaaatacacattcctggggcctagctttagcaactcagattccgtggctctgggatgggagttgggctttggctttttttgtttttaaggtccctagtgattctaatgagcaaccaggagtgagcctcactgattggaggagaactctgagctgtgtaacatttttctgcttttgattgagtgacaaacaatcctttggttattttcagctgcagatagaatctcaattgagaaatggcatgtcccacctgagctagaaatgaaaactctggatttgagctcgtggccagtctcctgtcctccccaagttcaggctggcagtatggggtcagggatggagtttgttgaagtttcagtgtccctgctgcccaggtgaaagggggtggagaaggagatgacagggtagttggctcactagtggctttgtgctcttggaacctgggaatgttcaatgctgatgtgccgactttctttcctggatacctttgtgggcttttggagatttctctctctgtatttcccatgacatgaacaaatgtgcctctgctccagctggcacaagcaactcctaactccaggaaagtactttatgttgttggggtccctcagcaggacctgactccccacaaagactttctcctgtgctgcctctggactgcaggggacactcatagtctcttgtcccctaggtgtacaggtcaagccaaatgccacctataccccatggctgcaggtttctttcaccttctctggcaagggtcaggccttgtcctctgagccatccgtttgcagagaacataattcaactctcagagtggttccatggaagccccttggtggggtggtgtcagagcagcacttccctaaagaaacttctttataaatccttccttgttctctccttccggggatatcttacactctcaaggtgaatcagacatttccaaggacataggtccagttctcagccagttcctttgtgatttctgcctctgagtgcctcacatcactttggtataagttactgaggcaggaagagtctcacttaacatcctattatgctagaatctagggattttgaacaatgtgccagctgtctttggaggtatgagaaacagagggtcctgggctaccccttgcagcgagttgtaacacttgagacaacgtagaccctacctcttaggaaggtggcaggggtggggtgcaggatggtgggaataaaacacagcctcttgcccatataacaaaagacaccctagccaaccataaaatataaaaggtggagaaacacttggctgcttattcctgtcccctgttcctctttgaggttgcctttattctggttgtaagacatcagcttctcattcccagggatgtccctgccttgatattaggcaggacccagatgaaggtatgcagaaaatataggcaatggaggacaaagacacctctttaaatcttctttcttgtggaagccagggaacagagactattaaatggaataggtggaacctctaagattttacttctaatgagataaactttcacttattctcaattcaaatgactcattcagatctgatgtttgaacttggaatcctgagcatagttagcctccactttccatattatttaaagagcagctttgctgcagtgggaagggtttgggttttgaactcagatctgattcagtcacagatctgagttccatcctccatgatctttgcggctttgagcaattttcttaacaccttggagtgtgaagcgtgactttccttctccataaagtgtagggttctagccccaagtagaggccatctgcctgtcatgtgtcagccccagcttagaaggttgccgccttgaggctgagcatatctgaagtgccgatgcagtgcctgacacatgataggcaggtgctcagtgttatttatcctctccttaggtaggcattgagaatatgataaaggaggcgaacattccccacctccctttgtgtttatgccctgtagccattagggagcagctttctacccagaaatgcttttatctcagactaactctgcccttccttattcagaagcatgggcttgcccagaaaaaggatcttgagactctatcattttactacctgagctttctagacttggcccttgatatgatttggctatgtccccacacaaatctcatcttgaattgtagctcccatgatttccacgtgtggtgggagggacctaatgggaggtaattgaatcatggggtggatttttcctgtgctgttctcatgacagtgaataagtcttatgagatctgatggtttgatgaaaggaagttcccctgcacacactcttgcctgctgccatgtaagacgtgtcttgcttccccttcactttctgccatgattgtgaggcctccccagccatatggaactatgagtcaatgaaacctctttcctttataaattacccagtcctgcgtatgtctttattagcagcatgcaaacaggctaatacagccctttaaggagaaaattaagtcaaaaatttgacccacctttcagagggtgggtcagtcttagatctttctgctgtctaagctcttttcccccttctccttttcatttggaatgtagcctagaaatgtgctgttggggacaaaaccaatctcctgtcctttcttcttttttgtagctatggtcaaagataccctgactccaatatttaggtacctggctattactttgtgtttcattaaaaaaattgtcatttttttgctgagtgcagtggatcccttgaggctgggagttccaggccagtctggtcaacaaagtgagaccccgtgtctatgaaaaataaaaagaaataaaaataaaaattgtcgtccttcatgctcactgagaccttttgactctggtaaaacttctcagtgagttgttaaatcagggcttctcgaactttaatgcacataccaaactcctggggaccctgttaaaatgaagattatgattcaatggatttgaaaatgggccaaactaatgtatttctaacaagctccccgatgatgccagtactgctggtccatggatcatactttgcttagtgaggatgccctgcagaagctggagggaccactggaagaactggtcaggcatccatcaagatgacctcactgactttccctgaggatatcaaatagtaataacaatacaaatatagaatagatggtgcacagagatgccctttaattggttttggcataaagttggatgaattcaatatgtggcttaagaaggctagggagagtgaacaaaaagtagagacagcagttgcaggcacgtacacacacacagggtggggttatctgaggaatcttcaaaagttctcatgtatcctatttagcttaccagccaaaaagaaagacttgtctaagatgaaattgatccactgtatgtcagtcattgaaattcaatcctccatataaaaatcccttcatgaaccagaaagtgtacatggagactgagtggagattagaagtgatgaaggtttctttttgagtagaatttgaggcagaaattaatggcagagagatcacttatgatttgttgtgaggaagaaacctgaagcctttgttagcattttctgatcagatagcccaagttgcaacaattttgaaggccaggtagtcctataaatgtgaacatcacgttgatgcaaagtagattctgttcagaatcattacccaagtgatttaaccctttggcttggaacaaacctaaccagagcaccagatgataaaataccctcgttttaaagcttaccattctttaggcagtacataaagagtgtctgtatggcccactcattcaggaagaatgtcacagctcaagaatgctcattcacacaagcagtgggagtcagtgacttgcgcttcctaattcgggagctcctgtctcctatgcgaaatgcgcgtcaggaacaaactataaatattggaagagcttttcccacagcttctccttccgtgctgttttatcgaaagattcatgacatctggatgaactagagctctctgcggcacttagaatgccccacactggtggatttagatttggtgtacttagtctaaagaacgaggggagaggaaatttctccaaatgttatgcattaaataaagctctcctggctttatactatttgttcctttggtcttttgtcaggacctatttcttgtcctggaggtgaaggagagaaatttatgtctgcttttctgccttaaataactgagaagagaatgatttggccatacattcagaataatgataattaagatttatacttaaatagcttcttatacctcaggagtgctaatgttagttaattatgcttcccaaagctcctgaggaattgccagagccaatgctattatcctctcctgtcttatagaagactccattgttacagaaaaagtggagactcccactgctatatagcaaatgagtggttcagccagaaaggaaaccagatattgcaatgccaatttcaggcgctgagttcagcctgcccttctgaaagagaagagaagaacctgaaaatcaaaaggctgatccccccatgagtgagaaaatactgtcggcaaagcaaggacagtttatttgaatagaacaaatcttttgtaattgccttatcatatggaattctttgaaatatttttcaggatcacatgatcacattaaatagagtctgcaaatagaatggatagaaaagtcttttctctctctctttttctttaggtagagcattagagggagactaaaagtttaaaggaaggaaacagatgtgtcttcctggcctccccattattttttatcttgttagcagaatggaaaatgaaccctactgtcaggctacctctcttcccacaatatatttttttttatccaacaaacctgtttttcctttaactatagagtcttaacagttgaaatgtcataaagatgttttctctttcatcaagatttacataaagtcataagattattcatgagctataagtgagtttagaagatggaaataaaaaggtcctattttaggttattttgcatggaattaggaggatggtgcagtgcttgggtttgatgctgttggggaaagaggaaagtgattccatctttgatgtgtggaagaccaaatgccctcagggctcatctgcctcttggaggtgcagacctcactggctccctgggaagctttgtcaggagtgcggctgtggctgtgatacagttgctatccttcttttactatttttttcaacttgtattttagaatcggggtgcatgtacaggtttgttacgtgggtctattatgtgatgctgaggatggggatgtgactgaacctgtacccagctaataagcatggtatccaataggcagtttttcagccttcccccccatccgtctctctccatcttcagtagtcccacttggggcacttcaggctgtaccgtggactggctactcactttcggtaattcttgacaacattccttaggtcaagaacaaagtaaaggtgagtatggcaccttaggatgctcaacacgttcttcagaaaacaggatttgaccatcagatctgcagaccttggtacttggccttcaacctctttcagctgaggaggagttgcagcttacatcccagtgagctgtggggatcatagacagtctgctgcttgtttggaactccagtgggttgaatagagttcctggatttcaatattttattccactgtctcccaacatgaagatttaaggcttgacgctacttcttgctacctaaatctgagatttctgatttgatgagcactactaggatagcactcaagaaatcataataaccctttcaaaaccccactttcaggggcatggctcaagtcagatacagcttctttgtctttcattaattctcttcttcttggatttttttctcatagctagtgtttgtctttcctcagtgaccttttagtcctgaatatctccaacagggcttcctaactttagcatataacagtgtgcaacagtatgtaatgaaggaaccatttagaaattagacttaaaaatggcaagacattttcaacatctgaccattgccagaagtctaaaaagaaagtgatacattttttctgtcagcatttaaaatgatgttaataattaccttactgttggagtgtaaatatcatgggaggttttgctaaactaggaagttgctggaagcaaaatacttgatgagctggggtcagctgtagtaatgtgaccctcacttttcataaacattaggtctctatcctctcacgtgccagtctaactaaacctttgtatactgagaggtgtttatttgttgtggtgagtagacctttgtcagacatagtgcagtatgcttgggagaaataaaagcaactctgttatagttcgtctcacattgtctttctgcgagtttcataatcttacactaaatttggctgttgtggacaaaagtaaagtgacagtacttgtcatacatctgggaggatgaaattaggaaaaaatagtgcttttcacaaagtttagatatggcctaacagttttgctggtgaacttggtaggaaaggcatgcgctgatatgggtcataagactggatggacactgacctatttttaattaaattaaattaaattaaattatttatttatttttgagtcagaatctcactttgttgcccaggctggagtgcagtggtgtgatctcagctcactgcaaccaccgcctcctgagttcaagcgattctcgtgcctcagcctccagaatagctgggactacaggcatgcaccaccatgcctcgctaatttttgtatttttaatacagatgaggtttccccatgttgcccaggctggtcttgaactcctgagctaagatgatctgcccgccttggcctcccaaagtgttgggattacaggtgtgagtcaccacccccggccctggcctattttttagattatgggctaacgtctttatttacgattggaccccaaatcccatttttccatacctaacatttgttacagtgaatagatgtgatgttcttggatcttcctaggggcttcgtgtgggtagtgtgtttggatgttcctgttctgcaacgtggcagattaaacctgtatgtcattcatagtcactgaggccgtttaaatgtgtggctgagataaatctggctctgaatcctcaggcttgtcactttcttatggagctgtaggtgtaaaagcgatggtgaccacaggcccttctctcacatgcggtgggggtctgtgggggcctgagaataaatcagtggccaactcctcccaggctaaggagtgaaagccccagaactagaaaaagccctcagtcctgggcagatggaaaggatgtggctgggagtgtccccgttttaaaacttgtaaggaatcctcttagttcctggcagtctgggatggttggccaccctactgcaaatgaagacccacatacttatatccaaatatttaaagattataaatcaaatcagtgaatgtgaattgtgaaatagagtaggttccaccttcctgcaagacaaatgtatagttatgatgacgtggaaggctggatttgaagttgaaaatctcatattgtgttgaaaggcacatcaggaagagggacaagtgaaatcttctaaactaatggattactgagtactttgaagactgacttgctctcttgggcttatagaatctttccttcagcaggggtagtaaattcccatggtgagggggactccatttggtctagggcttttgtaaagggaaaggacttcagaggacaactgagtcccctgcaagtgacatcaggagggcagccactgggacttcttgctgctgctttattcattgagttagccctcaaactacagggcagctttcaagactcttctcagagtgttataacagctataagcaaccctgacaagacatattcacatatgataactcaaaatgagtttgaattggtgtttgggataataaaattcttcaaaatatgattgaaatttactggaatcaatgactttgcatacattgatacagtgccatcatatgtggctgcacagggtgtgcactgcacaatttcccatcacatgtggctgcacaggtgcacagggtgtgcactgcacaatttcccatcacatgtgactgcagaggtgcgcagggtgttcatggcacaatttcaggtgatgttattcacatggactacaacattaaaggcgccccctagagttgtgcgaagcatgcactatacagcagtatgcagcatccctggatggaagtacacagccattcatttcattttttttccctgctaaaatagatatttttctagttgaaatgcgttacaattctaatttgaacactggggccacttttatttggttcttcatttagactaaccttgattattcactggggaatgcatgaacagaaaattggctcatttcgctttactttaatggcattttcctgctaagggttcagaagtgaaatgaaaactgagtaagctttatggtttacaagttttactgtttcacatggcaagtgaggactaaaagcataggaaatagctttggaaattcattttgcaatcacttaaatgttaaaacaaaatttaatttcatttccaagtagactttcatgtagagacccagttagctctgattggagaataagtagcaaatgtttttgttaccagttcttgttgatgctgagttaaaaaaaatgtttttggcaagtctcataggaataccttaaagcagaatattttgatcatcttggtgactgcagagccatcctccaaaattaaattgataacttttacatttctctctgacataccattttttaataacttcttacacatcaatgatttcaatagaggaagtacattttatttttctttgttgtgttagggcttaaaaaaggtttcttcagccctagaaactcccctgaagataaggtggagaataaaattgtgctttagatagcattatgcagggtggttaataacaagctcctgaatgcaaatggccctgctacacagttaacagtaaccctcaaaccatcagagaataacaaaagtggtacgaaaattatttgtctctggaataaaaataccgaaactgcaatgaaagtagccaattgtataagagaaacagtaccaaaagaagaaaaatggtaataattcattgattgctgaagttttttcaaagcaatttgtgatctttttttgtgatttgttttcttttttggagggatgaaagtgggagaaccggggaggggaacggagttaatgtggaacaactcaagaacttaaagttttgtttacctgtcctgtgaaagcagtctattaaattgcaaaacttcagtgtatgtctagcttattttagttgacataggttagtaattttttgactccaaaatgcatacttacaaatctttgctctgttttgccttttaggtgcaaacccaaattatcctgatgtaattatgaaggtagctatcgtgttttctactttgtatttctttttcaaaatgtttgtgtatcatgaagtaaatcaactgaaagaagactcttctaagctcagttaaatttacactttaagcattacataggccaaaatagtatttcaaaaaatcattcaatattgatggccgttttcccttgacatttacagtgcctgtaaatagcactttctctctcataccctgttcttggaagtagtgaatccattccgctggctgtaacagacatcgtatttccttaattgggaactaattacctgtttaaaagccatggctaccaagaaaagggaggtatatcagtttctggctatgacagtaaagccaattcaaaatgatgtttcttgtgtaatgaaggtgtttggctcacagatgggaacctcaaaggtagggcttgatttagggttggttaaagcagcagctccactatgtcatctgggacccaagttcccttcaccctactctctttttcccaccacgccagcttcactgaaggctggtccccttgtggttacaagagaatgtggcgggggagctgctgccattcacaaggatgggagaaagggaagcgctcctgaaggcgtcctcaaggaaagagaacttcccaagagacaagagccaagccctctttgtatccaagtcaagacccaattgggtcatagtccattcttgcccttattactgctaagagggatggattatcccttcagtaactaaattcacccccagactttaagtcagcttccccgaaggtggataggcttaaccccttgaaaaaaaaaatgggattctctcaggaacgtggaaagaaagaaaccaaagtccattatattagttttttttttttttttttttcccgagacggagtctcactttgttgcccaggctggagtccagtggcgcgatctatgctcactgcaacctccgcctcccgagttcaagcgattctcctgcctcagcctcctgagtagctgggattacaagcacgtgccaccacactcggctaattcttatatttttagttaagactgggtttaccatgttggccaggctggtctcgaactcctgacctcaggtgattcacccaccttggcctcccaaaatgctgggattaccagggttagccaccatgcccggcctatattagcttttgatggaatatcgcatctctcctttgctgttttgatcgaatgccaaggatgttttcctaggtgtgaaaacccatatttaacagatttccaagccagcaagccactgtttggggaagtggaaggctacatttcaagacttgctttaaatttaggaatgattaaaagattgattaaaacattacatttatatattttctgtaaaatattctgttccttaattttatatttatatatattgattgatattttattttttctataaaatgagcctgtctgtatgtttattatatgcgtgtgtatttaacctgagctaattttaagttggggaataatattgtctttacctgcttgtgcatgttaagccatatttcttccaagctgtggtttggttgattttttgcatatgatttgtgtgttgttgtgtttgtatttgtcttgatatggtttaaaggaagaatctctcaaattgtttcacagagaaatacgtttgaattgtggttttacatcttaaaattacatttttgaccctttcccagttaattcaagactttaaaaatgtcatcttcctgttagcctcagatcctactttggatcttttggccaaaatgtcatgatactaaactatagacacttgaatgatttaaattttgcagacgtagttggctataacatgaagagggaaaactaaacaaataaatgatatccattagtgtttaaaattaataagttttaagatattcaaaaggaaaatgatgagaatgtggttttggcattaagaatgaaacagcaaacacatagaaaatagatttttttctgttattttttattcacaaaggaacacattgctaataaaaatacaatttaaattggttgccctgaggccagcatgatgattctacctggagaagtttagctggggctgcattaacaaggtagcctcttcaggatggaaattgaaggcagtgtacctatttagaattaaaatacaaacattataaacctcattgtttgcaataagtttaccaagagttttctgagaccttttatatgcaatattgctaataaaaactttgacaacccctgaaaaaaaatcagtcattatttctatcctgacccatgtagactaaaattgatccagaaggcagcaactgcatttgcgacttggtgaaatgagaacagagcgttaacaattctaagtattgtgtggatctaccttttaatcattctgaaactgaaatattggcaattcagaactcttcaaaaaagtttacgtgtggacccaagtttcatactgatgcttgttccacatatcctcttacgtctctgccctttgtgcaaataagttgcacctgtcctggaaatcagtgttgctcatttcaaatctggcgtcacgtgtgagcgctaccatcttcttgccttcacctggtcatgtaactttcctccactgatattcttcagctgtaaaactggtagttatgctctgtctctgaagacctttccgggtctataaatctatgacacgtagatgatcgattccctgtcgtacttgttttaaatatgccatccataaaggggtatatgcttatgtgcaaagaaaaatccctgaaccaggtttggggctgaccaacaagacaatgatgtaaaggtctgggttgaataaaatgtgggcgttgtgcagtctcagcgctgcagtgcattgaactcagcagcctggtcacgtccctccacagccagactgtcgggggtttggaatctttgtgatttgtcttgcttcattctggctcttactgtggccctgtgtttgttggcagcttaatgacaacttcatgttcttcctcattccccctttgcccacttaagattatggaactgcagcgaatgacatcggggacaccacgaacagaagtaatgaaatcccttccacagacgtcactgataaaaccggtcgggaacatctctcggtgagtggaataaataggtgtctgaattggttctgagcattttggatgcctccatgttagaggaatgtagctgcttcaataagacacttttattgttcagatataaatagggtgttaacacctaggttggaagaattaataaaaggcttaacaaaagtgataaaggtgttatatggcctttgacttatttgctgcttttgtgcaccacttttggttgttagtggttcctatttcaattatctgtgctttagaagggtatcaccagaagagcaagaaaccagctttatcattcagggactacaccttcatacctgtctccttaaatttttaatataattttgactgctcgctagatgtagggaatccagtagcttctgaaagggactggcggtggaggggatataatcatatgaacaaaattaagattagttgtttagaattcatcagagaccctggaggtgaatattagcacctcaaatacaaatagaagcagagcaaggcagtacaagagatagaagtggaggagcagatgttttgttccttgtagctgggacactctgaggagcctttgtggggcaagtgactttttgcatggcctgtgcagaagggttgggattttgacatacaggaatggaagagaagggcatttggggcatgtgaacaggagcttgtaggtggagaaacatcgtgaaggtgcttgattggagggtaaggcatgtgcaggacagcagggttggagataaagattgtggccaggttgtaggtcttgacacagagtctcaggtgtgtagatttatggcacagtgaagagccattgaagagggaagtcacatgatcccaggggtctatggtcagttgctctggtccgaacccaacaacttcctccagttgtttcttttcctcactgtcatatgcacacagagcttcctgtgagctctgcctccttataaattccaaatctgtccatatctccttacctccactgccactgtcacaggctaacccaggggttggcaaactatgacccatgggccaagtccagctcaccacctgtttttgtatggttttcaggctaagaatggtttctaccttctaagtggtttaaaacaacaaaaaagaatgatatttcataacacacgaaagttttgtgaaattaaaattttattgtccatgaacagagtgttactggaacacagtcacttgtgttcatttacgtactgtctgtggctgctcttgtgctccgatgggggtggagtagttgcagcagagaccatatggcctgcaaagtggaaaatacttacttctggccctttacaaggaaagtttgcctcagttgttctttcctgcatgaccacgcagcctcctaacccatctccctctcccagccttgtgtttcctggtcttttcccacacagcagccagagtgatctttgtaaagtgcagatcagatcattttttttgttgttataattctcagagtcctctcactgcaattgcaataaaacttttcatatgaaagccacactcttcatggtggcttatgagccctgggtgacctcgtccttcccgagctctctgacttcatctcccacgctcttcttactgcttgccacctgcctttttcatgctctctccagtgctccagtcctgctctttgtacttgtggctccccatcccaggcatttgcttcctgatggccatgatgtggcttcagctaggtggccagcatgcagccattgcccacttccattttcttctgagcagttatcattgtctggaatgaccccatttatttgtttgtttaatgtatttttctcttctctagattctttagtaagactcttagtaggggcaacgtggtcagtgtttttcacagctgtcttcttaagccttcagaatactggctgacacctagtaggcacctagtacattttgcagactggctagacttgcagtgaacagtatagggcagaggaattggaaaggggtgatccattaggggtttggtggagcaataaagacatgtgatatatacttgaaccaaggccacaagagtggaaatgggaggtgcgtaaacagatgcagtgcaactgcaactttatgcatatctagtatagaggtatgcatgcatgcacatgcacacacgtatacacacaaacacacatgcttccgtagatgactatatgcattacattgaaatagcaagaacaaataccatggtaagtcaactggggaatggtatctgcttcctgccgtatgcaatcattttagtttttaattcttataccaatccacttaatatttcttggtgtaagaaagttgtttgtgtacgtaagaaatccaagcagcatgtattaagcccaattacacaaaattatatgttgactttagttttctgggttttttttttttttttttttttgtgatggagtctcactctgtcacccaggctggagtgcagtggcacgatctcggctcactgcaagctctgcctgccgggttcatgccattctcctgcctcagcctcccgagtagctgggactacagccacctgccagcatgcctggctaatttttttgtattttatttagtagagacatgttttcaccatgttagccaggatggtctcaatctcctgaccttgtgatctgcccgcctcggcctcccaaagtgctgggattacaggcatgagccaccgcacctggccttctggggtttttaaaatacaaatgataaatttaggcacctgattggcatatctccatctatagtatagttgctggaaggcaagatcagtgagtttgtatattatgactttgcggaaggctcctaaaatctgtatgagaggtgcaatattgtgttttgtagaatttgtgtggttcagatattttatatataaagagttcttgatcacaggagggatcattagattagaagagtttgagagccaagaagcagatacaaaagttaaaaatgtttctggtccaacaagtgctcttccagcattttgttggatttgcaggggagggcagatctcccttgttctatcctaagaaatatcctcagatgaaaactaacccatcaagcagccaaccaaccaatcaaacaactgaccaaacaaactcacccatgctcatctcccgtgtaaaaaccacctcaacacatgcaaggtacacaaaattctgtatttctcaatctgattttgaggaagttattcttttcattgtcaaaggcatccttgtttacgaaaggatttaaatttagaatggcttcagtagctttaagtatttgtttacagatccttagctgcttttcagcagtagagcccacttcccattttctaggttgacttacacattctataactaggcagagaagccagggcaggcattactgtctaatgaagaagcagaagcttggataagtgaagcatctgttctagctgtcatgactggtaaaagcaaggtgtcctgtgaacgcagggatctaggactcctaaatcccagttaaggactgtccaaagcagggaagagactgtactgtggtactgctgcatggttgggggactttcaggccaagtcatctaacctcccccatcgcagttttcttatttatcaaatggagtttgactttgtttatttaggtattctccatctatctgtagaagtctgcaatttaataataaagaaacttatagctaaaatactatgatctctttcccatgaaaacattagttagaaataaagatttttaaaaaacacccaaagtcatgaggtcagcttgagtgaaatggttacgtttatccataattagctttgtaggagttgctaccattctgtttgtatataggctgcagagacggagttagatctgtattggctgggcatggtggctcatgcctgtaatcccaggacttaggctgaggcaggcggatcacctgaggttgggagttcgagaccagcttgaccaacatggagaaaccccgtctctactaaaaatacaaaattagccaggtgtggtggcacatgcctataatcccagctactagggaggctgaggcaggagaatcacttgaacctaggaggcggaggttgtggtgagccaagatcgcaccattgcactccagcctaggcaacaggagtgaaactccgtctcaaaaaaaaaaaagtctatactcaaacatttgcagaagcgtttttggggagatatactcacagttaaagtaccagagaagagaatgatcattacttttgctccacactggccaagagctttgtatgtcttctttttgtgctctgtgatttatttaatgctcttctcatctgacatgaaagatggtgtcctgggagaattagccatatgtttttattttcctgccttcattctcaaccacatgctttgcagagacagtgtagtggataaatcacaggatttatacttgggcagacttggttccatttccaagctcagaaggtgtgactgtgagcagcttacttaatttttttgtaaatcttagttttttcatcatcatcatcacagctaacattaatttattatatattgtagtagatactgttccaaacccattacctgcattaactcattgaggatttacaataacctacaaagtagaataattatattctccatcttacacatgaagattatgagatgcagagaggttaagtaattctgaagtcatgcagcagagtgagaaatctagattttatactcaggaaaaacccatggtcttaatctctaccctataatgcttctcactatgagatgggtatatcagtcagaataagctatgctgcagtaacaaaacctccacatcttggggacttaaaacaacaaagttttctttcttgcttcatttcgtgtattggctaggagctctgttcagccttgtccttgttccaggactgtggatgacaaagcatccacatttttaaaggttagcctttttctttatgacagagataaagagcactgtggagcaggtggagcagggttcctcaaccttggcactattggcgtttggggataaataatcctttgtttggggggctgtcttgggcacagtaggatgttaataatgcctggcctctacccactaggtgctagtagtactttccccctcgttgtgacaaccccaaattgtcaagtgtcccctggatggcaatattattgtccctggttgagaaacactgccttagactaagatcttggacaagaagtgaagttctacaccctggcagtgacacaagtctgaactagtcacatgaaccacttaaccacaagcaagccaggaaatgtatcctacaaagagaaacacagagaaaaccagaaatattagacaaacagcattaatgattactatggatagggataataatatccatcttaaaaattgttgtgcagattcttaagccagaatggctctctaagaaatctcagagcaggcattggcgactatgttcaagtccagctgctgccattgtaaataaagttttattggaacacagttatgcccatttgtttacatatcatcattggctgctttcatgctccaccggcagagctggatccttagttgcgacagagactgcaaggctggcaaagcctgaagtatttaccatctgacctttacagcaaaagtttgccaactcctggtttagagaagccaactgtttttggaagcaggactttgggctgagtaagactggaaggagacacatagtgccgctgacaactttgctctaaaatgttaagatgcacttagaggagcatcatgccttggtcagcagcaatggtagcagagtgatcgcatttctatgtgtacctctgtcatctctacctctgggatgggagaggattcacatatatctacatctaccctcttgacttgtgtaatccacacctggcaattacatttttaaacttacttaaacatttttaggcttatatcatatatatgggaaaatgcacatatcataaatttacaacccaatgggctttgacaagtggaactcaccccagaagtgccctcctgctcccttccagtgccactcactgttcccagggtaccctgacttctaagagcaacaatagctaaccttaaaaatagccttttattatggacaattttcaaacatgcacttcagtagagagaatagtaaaatgaaccccattgtattcttcaccagcttcaagaattatcgggctggatgcggtggctcatgcctatattcccagaactttgggaggtgtaggtggaagaattccttgagcccgggatttcaacaccagcctgggcaatatggcaaaaccctgtctctgcaaaaaaacttaaaaatgagccaggtatagtggtgtttacctgtagtcctagctactcaggaggctgaggtgggaagataccttgagcccaggaggtcgaagctgcagtgagccatgattgtgctattgcactttagcctgagcaacaaagtgagactccgtcacacacacacacacacacagaaaaatcaccagtattttgctgttcatatttcatattctctctctccctttctctgcccacctctctttctctctctcctccctctttagatggatggagagagagctgtaatatttttaaaatgccaattggatagccatttttataagctttaacttatgttttctcatttgtaaagtaggcataataatagatcttacatacttcactatagggttgtcgcagattaagtgagttggtgtacataaggctgttataagaacaagtggtaagcattcaataaatatgaactgcctgtatcattatcatcgtcatgatcatcatcaccatatgattatagggaactaattagcaaggttataaccaccctcccttcctttctctaggtctatgctgtggtggtgattgcgtctgtggtgggattttgccttttggtaatgctgtttctgcttaagttggcaagacactccaagtttggcatgaaaggtaagaagggttgtgtttatttagcttcttatgtggatcatttttggcttatgactaatgctaattaccactaaagaaggaagtggctagatttatgatgattaggttttaaggctaaaaaaatagcaacaaggctttgatactacaaatcaagacggagcaaaataatgttgattactcagcactacccacttttccatgagaacagttgtcccgggagacagaactgggttcttgagtatcaagggactaataaagatatgacaaagaaatagtacttgatgtttcttttgctccagaaaggcaggtgagacacagtggggataggataacctggacacatgtattttgtgcagaaaggtctatgctgctgtacatttgattcccaaatcttcagtggtatgcttttggtgttgttcctgcttttccagatcctcattctttgaaatttaaacaacagtgttatgaagcaaaataagaacagctatcagcagtatatagaagcttcgtgaatacatagctttttttttatttaagtggaaaaattagcagggctagattaaaaattaggcactaattgacccaaaatagataacttgtctttttttagaggatggaaaattaattttacagggaaaacttgtataaatttcttgttacataaaaaatgccttggagcagtgatttaatgatttaaaaccatttgctctgaagtttaaacttatgtattggataatatgccagtgttgtattttgtgtggtctcctatagatagacactatttaaaagtgtctaaatgggaatgctgtgaagaaggtttagtggtgtcttagttgtgctggagagtaggtcaggtggattttctttatctgtatggtctgttagaattatgggtaatgttgctaatattgctatttacttgaaagggaatgtttcagtagcaataagttgcccagcatacactgacatctgggatagagcagatctatttctgatgtttcctcttttccctttgttggtgcctgtgaacatttctaagccagaaatgaacagggaggagtggtggtaaattggggcttaaaataactcaaaaaacctcgtcctggttcctgcttggccagctgatccttgatgtttcttcaggggaggaaagatctttcattctccaattataaataaagcttgggagagggaccaccccacagtgattttaattcatcctgtggggtggttctcaaacttgactgtgtgccaaaaactcctataggacttgagaaaacacagattcctgggctacccctagagtttctgctttagcaggcctagtgttcacctgacagctggcatttctaacagtttctggagaatactgatcctgcttgccctggttgttgtgttctctacacaacagtgtagggaatcactgttctctacaataaacatgggctgccaggcccccttcagaatgtgacaagatgttggtagagacatcgcaaaccaaactcacccacagctttgcacacattttgggatccccatatctcaactgcacccaggcccaggctaggcggctgctctgtgtgtgccgcaccctaccatggcatttggcggttctcatgtttatcaggtgctttccttccttagaggcacttggactggatgtctctaaacatagatttcactggaggctaccaactaacattagagtttctggtcttgaagggtttagtttgaaatatttcatcccatgagctttttggagagaggatatacccaggttcttctgggatctcagcaaaagctaagtgggaatccatggagcaaaatttaggaacttcttcccacccttggtttaggaaaatcactggcagaattaccagtaaatggcaacctactccttacaatgtggcaatggaggagaaaaagcgtagacattttctttcagagaagaaaattatgttgcatattgagactccagcactaacgctgaaacagtatttcatttagataatttggggtgattaccactaaagcgtctacgttttctgagtataacctgagggcatccttaatgaattataagaaagagtgtgcttaaccctgccacagagccagtaaatggcttcctacagcagtaactactatacatattgtatgttttgttccctcattcctacacacaaataaaatcatttttagaaattttgtctcagagacttttttttttttagaatagcttactgttctattttaagctacatgtctatctggggcatgatgtgaataaaaagagcctgatctagggttattgttttgcaagtcagatgtcgagttgataaatctttggggatctagaaattaagatatggttcatgtatcaagtgcagatgaaactgcttaaaacgtggtatttaaacattaatgtgagtcagtgtattttaaatgctattagagctgagattaccactgaaaaacatatgcttaaaaaagggaagaaaatgtaaaaacactattatgcttccgaaaataaccaggcaatgtattagttgtggtttcttagtaacaacggtatgaactgtgcatagctttggccaggactaggcaccatgtaagaggcttgtggctgctgtgcagatgagctgttcagaatgttattcctcccttcctaagcatctttggggagggtctaagctcatccttattctcttttgctggaggcagatgggacaggaggaaggtggccagctcacccataggcactcacagctttttgcccatccctagcaatgcgtggtttatttcgagtgttgactgtttcaatctgtaatggaaaactcgagaatataaatgacagttcaatgctgctgatatgaagggcccagagaaacaaaccccagaaacctcttaaggtcaccacactacagctgagtgcagggcaacacaagctttatggattggcctgagatccaccccttactcctgcaaacattacttatggtattgctcccatggggaggtgatttctaaattccaaactagtgagtgaaacttggatttgtaaatgcaaccagtgaattgcagtgttgtctttgaagatgggtctgcaggtctgtaagcttcgtcgggttttgttccttgttctgtggattcatcgtaaaccaaatgctgatggtccactccagaacaggcagcacagactttgagctccatggtaacagcattcatatttgtggtgttcatctttatctactgagtgcctagcccagagttggcgctcaatacatattaacgacagaatgatcagagaagattttcaactccgtccacctaagttcggtaattggaaaacagttagtatttggaggatggctaaacagtgagtgactaaagagagaacctgagacttttctaagtttctaaaagagacaaagtcccacctcttttttttttttttttttttttttttttggttattccatatgagtcatggccatagataagagatcagtttgtcccggttttgtctcagggtatgtaggttttcacacactgttttcaacaatcgtcattgtttaagtttggaggattcactttgactttttattttgcatgtgaacatcttcaatttctacctccctacctttgaatgtatcgttttggaatatgttgttttttcagttctgaagttggcaaaagtgctagattggggattttatcttgtggtaaacctagaatttatgttttattcttgcttgatagagtttaagcttcttgctgctagtgtccaataggctcccggccctgtttccataaagatgtcaaggggtagaatatctcccagtcagtttttccttgtttatttctgtgcctttacactgtcctattgcttttttggttgatatgtagctaccataattgcagaagccaaataatgcccttctgttagtgttggccatctatgtagggcttattcatacatatgtttaatatgtatgaataaaatgtataccaaatctgtctaaatctatgtcggtatcaatatccctatatgaaaatgcataatattatcccttttcttctaaggctgcctctggtttgttttaattttagttttcactgaagtagggctgaaagaattttccagaacagctccattgccaaaggaataggcaaccatgcctttgaatgctctccttgtgttgtaaccaagtcttgtgtttagctctcgcattgcttcctggctccgtgtcttcactgaagacgtaggagtgcatgtgaggggaaaatggaagcattgaggagcaccagagctgccaagtcttcaaagggtgctccacattgggagccctgcctgtggcattgatggtgtacagggttgcaaaaaatataagggagccagcagggaggagggagcttggcattcatcaccctgctggaggatagtttcggctatcagttttgtgttatttacatttcctgatggaagtccacatatgatatctaattcctaagtactaatgcagcctttgtcactcaagagtgaaatatctaaatgaccctaagaaatctctgtagaagagactagaagaggaagctttcttctcattcagtgctaatagactgcacagatttcctctgcagcctctgattcttgtatgtaaactcccctatccacattcatttgtcctacttaagtgttggaggtttccaactagtaaaggctggaaagctaccctgccttgggatgcagatctgggttttcctaagtccagactgaaggcccacagttcaactttctgctcttataaatgatctctgagtgtctttcaatagcaaccaaaaatctgcctatttaaaaatagtcataaacatagcggggccaaagctaaagaggttgaaggttaaagccttttatatgagctgaaaacaattctgggaaatttaagaggttgagtttaacagatatttggatcaacttttaagaggaaaaaatgtgaccaaaagccagaaacacagttgtagaaacatctgtaaggacaaactgttttccatatgcaccctcttccttcttcttttttttaaagaaaaatgccgtcaaaaaattagaatggtaacaattgaatgcactcttgtttttcaaaatttcaaggagtttagaaatacctaaacataaaaatggatgttcccatcaccttcttctgcatgaccatttccactcctagaaataactttctttaactgtatagggtgcatatagtatgtaaacaatcaaatatatggcttcatttttgattccataaggaaattataataccagtcttgttctgcattttttgggggtaacaatttgccttgcggatttttctttatcagtacctagctatctactacattccatttaatagtatttcccagttgtctgatatcaggctacttggatctgaaacctggctctgcctcttacgagctatgtgactttgagcaaatatctcatcctctcttgcctcggtatttccgtctgtaatgggacaatactaatacctaacccatagggttgttatgaagacaaactgagcttatatatataaaccacttgggaatgtttctgacacttagtaattgctctataaatatgtaatgttgttaatattattgacaaattatgatttatttgacttttcttcttttaatggacatttatgtttttaccaagttttcagaaaattatttcaagtaattttcaaataatatcttctgtataaagatagatacttggaaatgtattgctaggaggaaagatatatatgtttaaatgtgaatagattaccttgcataaatgcctttccaatttagtctcccactaacagtatgtaaggataccctttcatttcttactctgatctatactgaatattatcaatcttttggctatttgagtttaaatgatacattgattaataatgaatgtaaatatctttatcatgtgaaaaataagagtaatgtttatttttattgttgagttatagatatactttgccaattatatatatatatttatttattcatgatatttgtggctcatattttcttctagtcttttgactttttgatagtgtcttttggtaaccaaagagatttacctttttataaaagcaaatctgtccatcttttccatttaagttgtgtcttgcttaggaagatctttcctgctctaaggtggtaaacatatttctaaatatttatttcactagttttttactctatgtattttttaaacttagccctttagtctttttgtaattattattattattattattattgagacagagtttcactcttgttgcccaggctggagtgcagtggcatgatctcggctcaccacaacctctgccgcccagcttcaagtgattctcctgtcttagcctcctgagtagctgggattacaggcgtgcgctaccacgcccggctaattttgtatttttattagagatggggtttctccatgttggtcaggctagtctcaaactcccgacctcaggtgatccacccgcctcagcctcccaaagtgtttggattataggcgtgagccaccgcacccggcctttttgtaattattttattaaactttggtatgaagtagtcctctctttttcagagacgtatagaataaagatatttgaataaattctagtgtgacattttcatagagatgaataataatattttaaatttcttgtatcagaaagccactaataaagcaaaagagaaattttgaaaatctcagtaattaactctttctttgtgaaacaagtaatgaactttgccagttctttcttatagcatgggaatataaaccacacaaaatagtatcagagaaataagttttcacagaaaccctttgttaaactactctcctcccagcttcaagtggagttcaaagtctatctcagcactctcttaagaggcaacaaaatttgtcaatatcaaccaagtcctcagaaatttcagaaaagacattcagttgaaagagtcattgagtaaggtaacaaaatgaaaatgaatctagagaaaagaattagtccaagtgttccttttctgttgtttggcgatgctatagaaagcttttcccgtgtgtttgtgaggtgaggatctactttttaaagtctcttacttctttccctgccaacatttggcttctgtctatctgagagcagaagatgcttattctttacaacatattgaaaatgtgtgtcagacttctaagaattggctagagtagcccagacaggaagcaaaagaatcggcatctctgcctttagccttgtaggtggatgcactctaccttttaattgctggttttacctgggaattcccacaaccgcagcatgattcatgtgagagctcttgttttcctgtaatgtagaaagtgcatgcaatattgtttgggactttccatgctagtattttcactaaaggtgaaagagcctataaaaaattagattttgtacttaaaggtcaggaaatattgttaccacttctttggtcttccattaaccttggggggaatttgctttgacctcctcacatagcttatggcctatttcagacaggactttcaaaatctgaaaatcttctggttttcttcttcttttcccccttcacttctcttttacctttcgttgttttccctgtcattttgtcctgcatgtctttgctttctaattttatattttttcctctcttgtttttcttccatctcattcctaacatctgattttggtggaaaagcttttcagaatttatgaagaagacagataataacttggcttaaattctaacatatgctttgattttatcttactttattttgagcaagaatactaaatgactatgggaatacatttagctctaaatcagcagaattgtcacgtggcacttcagaagacagcctgtttgaataatgcacatccttcatgtttgtaagttgttaactcctgagtcttcaacccaaggaacatataggaaagtaatattgaagacatatgaatcaaacatgcttgagtttaaatcccagatctcccgcctgctggtcatcattttgggcaaattgttaaactctaaatcttaattcctctttggtaaattgagggaataatactcatctcttcaggtgattataagaattaaatcagtgcttagtttagtatctgtctctttaaactaattctctaagaggtagttacttttcagatttatgttttagtaatacattattaaagaaaatattatagggtgattcttgttgaattcatattgaatctggaatgcagaaaaatgtcgcaaatgtaaacagtgaatattagtgtttccaggtttattagttgagtctatagaaaaaaattgtaattacaatgtgtatctactttatgggtatgtatcatgaatacaaatgtgctgatatgtgtgcttcttttaagcccttcagccctttaatacactatgtgtgaattattgcaaattcttaattttattgtcctctgaagaattcatcactttaaattattttggggtttataaaaacttgtttcattgattgattgatttggtatgtaggttttagcagtttttcaggggagaaatattttccaaagtaaagaggtggaaagggcaggaatgggagggggatgggaccccccaacacccactagcttagatctaaaaacacgacctcatggaaacttctaatgtgtttcccttttgtacagaaaggattataactgctaaagtgatttattttaaaaaataggccttaattctgatgtatgtacagcctgctagaaaggaaaagagggattgtcaagaaattaaattcttccttatgcaatagattgtcatttatattattataaccacagaccctgcattttctgtgagaaagccaaggcttggacaggctaacagtggtggaagacctttgtttttatcaaagcgtcagcaaaagcagaaacacattggccttttctgtgatcatctgggaactttagtggcctgaggacaaagagaatgagagagagaatgagccagtgagctagtgacctgatctctatttcaattctttaagtcttttgtagacattaatatcctggattgaagcagaagagtcatctctgtcttcagcgacagtgtaaggaaggaagggggaggtgacttaaggggtgagggtgctgtggggagggagaatgttgagaatgaagtggtgtttctatttatggttgtggttgtcaactttagaagtcctggcaagacttgagtatagtcaaccacccaactgagcctttcctgcacttgcttcctggattgcctgtaaatgaaaattgcataaagaccagaaatattataatagtacaggacagagaatcatctgagcctcccctccagctttaatatctaccaccttgttacaaaaccattatatacaatcacacactcactacaaaagtctgccctgcacttctggtgagatcctttattattatggtgtgtaatgatgtaatctttttctctattgtgtagccacagtctctttactgttgacatatgaaatactgcatctggagccaacactaaatatccctgactataccttcaaatgtgcggtcatctccagaaaatattgcctctaagttatcaatagaaggtattttctatttagttggcattcccagtgaatctgtttactgttaatttgcaggtagcatgcatcttgtcagggtgatatggtttggctatgtccccacccaaatatcatcttgaattgcatctcccataattctcatgtgtcttgaaagggacctgatgggaggcaattgaatcatgggggtgggtctgtcccatgctgttctcgtgatagtgaataagtctcacacgatctgaggttttttttttataaagagcagttcccctacacaagctctctcttgcacactgtcatgtaagaagtctctttgctcttccttcatcttccaccacaattgtgagacctcagccctgtgcaactgtgggtccgttaaacctgtttcctttataaactacccagtcttgggtatgtctttattagcagcatgagaacagactaataaacaagggtacctttgacattccagcttgagagcaaagagaggcagccctgccttagccatctcttcctggaatggtgtggatgtcagggagcagctcaacatgtgggctgtttcttgatcttttaagtcagacttcatagcatggctttgtcattttgtttgaagtaaatccttgaaacattagatgtttctatattgaaatgacatgcattccatagcccaaaagacataatttctgtgttatttacttgtagcctttcctctatgagtgaggacaagtgcaaggtgattttagaggtagatttatgtgcatattatgtaatcgtttatccctcacattatatcttcgttttcctgtgatgtcatggcagagggtggattaatcagtaaaatgtctaggattggattgagaatgagcagacacctatctcaggcacaacctgtgagccatgtgactttatttttctattgttcaatgaagtatacccttttagccctttctgtactgagtagcagaaaattaatctcctaccactctgggtaatctcagacaatggtgggtaatcacaaaaaattccacactttctctgtcacttcaggtctctcactttcctctcccttactcaggttgcatttgcctttctgggaaatagtggagagtgtgctgcaagttcaataaagtgccacagtgtggccttggtggtaatttctgtatgctggtggctgtccatcttcccagttgtccttggccaccactctattcaagtcataggtgtaccatcttgtgttcctaaccaagttctgccaccttcatatgtgtctccgcaagggtgtctttgcagctttggggacatggaaaatactgagactggcccccactgtctctgcgtagacatactatgcagagacatactattcccctactttattactcttgtgccattacaggcttgggattgctctgacttctggacaacttctctcgtcttccaagaaaggggtcctcaggattcttctttttgaaactctaagtctgagtcagggctctgtgtttccttaaccctcatacttgacctggggacaggttatagactcttcctgcctgtatctaaccatttttcccctcactgactctcttcctatttcctatggggacaggaagaacatgaaaaatgattttttctgatttcatcttcttccacatacttttcatcatatatgtggatcttggttttttttttccctccagctttttactgtaaaattttcaatatgaataaaagctgaaagaatactaacaatgaatattcatacactcaacacctagattcaacttctgcttaacatcttgttattgaaaaatacattgacagtatcatgttccttcactcccaaatttccagcatgtttttcctaaaactgaggacacagtgtcctaaaaccacagccacaataccattaccattgtgctcaaggaaattaagataaccctgtaataacagatattacctagactatcttcaaatttccccagtgatttaaaaatgccttttatagttacttatatatcaaaccaagatcaattcaaagttcatgcgttgcatttttttttttttattgagtttctttggtcccttgcagtctagaacatggcttctctttttccctgccttacactggctatttgaagagactaggcagttgtcctgtagaatgtccctcattctgtctctgtgtgattgttttctttggtattcttcaacttgccgtttatcctctgtatttcctataaactggaacttatttctaaaggtttggtcagattcaggtgagaggttttgggaagaaaacatcacagaagatgatgtgcacttcatctgtgtcacatctggaatcacattgtgtcaggttgttacactatcagtggaagttggatcaccttttgaagatagtgaccaccagataccagatcttttctttataaatacaagtttttccctttggaattcatagctggtttgtagggtgataatttgacatctagcaaatatcctctcctcctaaaacttgaacctactgggcttagcatactttcctaaaagctacttaatttctaagggttgcagaggtgtttttctaatccaatcatttcttctgtttttatttcattaatttttttttaaaggagagctttctggccttggccaagaatttcagctctttcattatagttctgtcttgatgactcttccttgaggcaatgattgggtgcttgggatccagctgcctacactagggagggtcataggattatagaaaaaaagttacagttaataggatcactatatcaaaaatattattttattataagagtatagttggtgggaatgcaaattagtacagccactatggagaacagtttggaagttcttcaaaaactaaaaattgagctaccatgtgatccagcaatcctactgctgggtatttacccaaaagaaaggaaatcagtatacggaagagatatccacactcctatgtttgttgcagcactgttcacaatagctaagatttgaaagcaacttgtgtccatcaacagatgaatggataaagaaactgtggtgcttgtacacaatagagtactattcagccataaaaaggaatgagattcagtcatttgcaccaacatggatggaactggggtcattatgttaagttaaataagccaggcacagaaagacaaacatagcatattctcacttatttgtagaatataaaagccaaaacaattgaactcatggacacagacagtagaaggtgaccagaggctgggaagggtagtgagggatgcggaggttgtgaggatggttaatgagtacaaaaacaccagaaagaatgaataagacctactgtctgatcgcacaacagagtgactatagtcaataataattgtagcttttaaaataatttaaagagtttaattggattgtttgcaactcaacggataaatgcttgaggggataaataccccattcttcatgatgtgcttatttcacattgcatgcctgtatcaaaacatctcatgtaccccataaatatgtacacccactatatgcccacaaaaattgaaaaacaataaataaaaaagagtataatgagcctaaatgctttcaggattcccttttgcattttgtggctggtggtagcatcaaagacagtgagagctagcagcaggtgagaaatcacttgcagcctttattttatagatgaggatggtgggcccagagaacttgagcgacttgcctgagggttacctggtttgtggccaatccaggggcagaagccaggtctcatgactccagcttcagtgttttctgctgtgaaactaagacttgtaagaagactccacaacacaacttatttccatgccatgttcactgcttgagcgtgtcatacgtgactagtattgtcttgcccctgggtaatgctatgtttctcaaagctggggacacttaagatctgtggtaacaagagagttttaggaggtgctcagggactaacattttaaattttggtaattctgttatctatttattttagtgttcattagaaaaaatatacctattacatcatactgttggtttcatcatattattgtttaggatgagactaaattaatataatagaaaaaattaaaaaatatggtttaaacaatttcatttcaacttaaattttaaaaagactattgggtaggactatccagtgcactgcaaatttaaaactgaacagaacaagctttccacctcatggagtttattaaagtttatgggaggggagagagaaaaacagagaaagaaatatagagaaatctacaggtgatggcaaatgctatgactgaaagtgaagcagggcaagagggctttgctgtgtttaaatagttaagaaaagctgctctgctacgatgacactggggccaagagtgagagaaagtgagggagggagctcgctgatgtcctggggaagagtgatctagacagaggaagagtgggtgcaagactaaggtggccagagcagagtgggggcctggggaggagagcagagagggatggaaatgcagctcactgagggacttgcagcatttaggagttttgttgttgttgttgttgttttgtttttttattcagagtgaggagtacttgtcttatccaaggtacttggatacgacagaaattgtgaaagtgtatggagagagattaaatgtgggcagcactgatgtaatgatgtattaaattaatttcttatactgaagcatgactgaagggaaagatatctcatgcggggagagttcctcatacaagagtatggaggaaacttcacttcagggtcatgatcagcttcattttgagaggagaatccacccctcaacacacatacacacactcaacacacaaacacacacacataaaacacacacatacacacaacatacacacattcaatgcacacaaaccacacacattcaacacacttttaatacatacattcaacacacagatacatacataacatgcacattcaccacatacaacacacacacaacacataatatgcacacattcaacacacacacttttaaaacacacgttcgacacacacatacacacaagacccacatgtattcaatatacagaaaacacctgcactcatcccagaatgatggcttgaggtttctaggtgtctgcggttcccctgggtcatagtgtacactcctggcatgttgtaattgttacccatcacatggccatggccacttgagactagaaagggataggacccagactttgacttatgtcttgactttttcttgaaattcttctcatcttcagcctgattccttttatacagtctaatctactctaaggcctgggatattatatcattaattgcaaggctaatataatttgagtaaaattttctcttcttgagatcttagttgctattgggagaaaaatgacactgaaaactcagctgatgcattttcagagtgaacaaagacattgtgagaattttatttttcctcctcacaatggttaaacattaagtagaacccatccatgctttttgcatagcattccttttggctgaaaagataaggatgaaactaagattttaagactcaagatttttgaggccatgtatttgcagagagaaaagagcacttgatttttctgtttattgtcctcctgacaaattattaatagtactttgccgtctttgtctgaattaatctttcttgaatcaccattggtgatggtgatagtggagatctaattatccaaatctcctaaaatatggttttctgtctcacacatttagcctaggaatgactgagtgtcacagtgcttcatctccccttcttaatctctctatattttggaaaatagttgattggctgtcaccttttgggatctcctatcttcttcccacatatttccccatactacgtctctctctcctctggtcctgcatgttgtgaaacagtgtcttctacctcttttcccccaaatatctgggaattcgattcttcttaattcttcattactgtcatatagctctttctctttacaaattgctcaatagtacatatttattctagtctgatttatttcccatcacctaaaatgcttatgggttagcaaactcagagacactaactcagatattaccagaaaaccagcatgtttgaaaagatggatctgctgtgtacagacttgcataatggaaacctaagaatggaaaataagggctatagtcttggataatcccattcattggcatgggctctcaaaaatcaataatgttaagtttgctttgacttctcagttccctctctagccagaatcttacactacagaacagattcttaccaatttcaacaattttcaattacaaaacaatgcaaggaaaaacagaaaagaagtctaatcagattcagaattttcagaattcaaatatgccaagtgtaggaaatgccaagtctaagtagcttagttcaatcactttagcactgattgtagcaaatgtttcaccttaaaatgatagttcattgtagctattttgtaactgtagtaattgttgagaattttgtttgtggaagacactcagtcattcctaggctaaatcctctccccttgccaagcccctccctccgcaggggtttttctttcatctcttgagctactgcagtgtcctctgaacccctgagatggaaaacatcccctgacccttggtggcaggtactgtagttacttattattcacttatttaaaaatggacatcatatctaggtgcaaaaacttaaggtgcccattaatcatcaatatgatctctctgttgggacccccagaaattcatcatgacttttgttttgacgtatctggttattcagtgtttgtaggtgtcaaagaaaaccagagctcaggactattgcaatatggaaaaagagagctcagtatggaactgggctcaactctgcatacagcatggacatgtgggaattcatagccaagaagcagggtgggtggcagtggatgggaaattactaagaggaaacatcaggggtaaggggggatcctggctaaaccaatgtaacaggactggtgctgagggcaggccagggtgatagacatcccctgcgggacagtagaggatgaggaacctgattagatgtggaggacaatcagatatggaagattttggcttaaccaacttaataggattcttaccaatccaaggcagacgaacgtggaagtccaaaagtcaggcctacttgagaaagagttcaggggagcccaagcagaggttggtcaaggagaggatctttgtcgtagggtgtactctgctcttccagttctagtcttccagatgtgttgacgtaattgccttaaattgtacgtggtcaaattataaacattattgaaaaaattttaaaaggcagtgtatggaactacttactaccctaacaaattaattgcatgtgttacttaaaaatattctgatatctcacatttctataatcattcataatagtacattagttaatcctaaaatcttatgacccaatctacctacccaattggctgtctccattgagtccctgaatgatcacctgaagttaagccagatttcctttctatagataaagatgtagaggcataagaaattctattttttaaatgacaagaatttatttgaataaggcagagtcttgaatctctgtactatagatctgtgttaaccaaatgcattgacgatacaattcaattcaaacagcatcccagaaatctcagagtggtgttgttggttaaatgaatatgcacatatgaaagagccaaagacttattgctgccagtgtttctcttggtttttaaggagttagccagtgctctttcccatgacttcagtctgagcagggtctgtgccctccattagggaccagcacaacgttcttcagcagaaaaccacaacagtagtgggttgaggagctcattttttgatgcctgaaggcaaaccttcaaaattgaattttatactctcaggaagtattgattgcaaacttattcctttataaatcaccaaagggaaaaatgacttgatttacagttaaatgcatatcatttggtgatgagcaaactcctgtgagctaaaggaagaggtgacacagacacgtttccacagcattttcttgattcatattgcagctgtcgtcagtgctctgctcaggtaccctctgactccctttactggccttgtgtgctcaccctggcttctgcatatgtttgcttctgagggtcacgcacctggaaccttgttcagagggctggacttgagctagtggagctcctccccactcctggcatgtgcatgagaacacacacacacacacacacacacacacacacacacacacaaacacacagctggaagcagctgggagttaagtgccttccactcccttccctcaaccctttgccaggttttgctgatgagtggtgaaggagtatgaaaggtcaccctcttgtcttaagtctgggcaaactctgtggtataatttacacgttctctgcaggatctgtggtataatttacacaccacagctctctgtagaatcaggctgaggctgagatttcacctgaagttgcaatcttgcctggcttcttcctcccctccctgttcccctctcctgggagcccctccttaataaatcacttgccatgaacactccactctgggtctacttctgaggaactggccaaagacagtgttggaacactaagaaatttaatatgttatttgatgccttttatcagcatctttaaaactatttctgtctctcatttgctaatttggactttatatgtgcaagtgggggaatcttaaaagttaatttaaaaatgaattgaggtgtagattatagttaccatttactgagagggccgttgtgggccaggtccttgacatatttttttccacgtttcataataatcttgctttttaaggatgagttaattgaagtccagagaaatttattaatgtgcccaagtcacagagctagtaattggtagaaccacaatacaagcccagatcttgtgatgttgatgtgttagctcttccaacctccctgctaactctcctttcccccctgggtattaaaacttctatttctagagctatcaaggaggcattctggcatcaaagtttatgacttactaaaatgaaaggagactgtctctttaggaagagataaaatacattagaaaatgccagacttaatttcccagaatgggagtgattgaaaataatttctaataagagcttgagtcatgtcactttgttgtatacagagagacttttgtgcgatgtttgacagaatctgggtggttcatagaaacacaaaattattcagcaggtgacaacgggacagggcattagcaatgagatttgagagcaggagatggaaatttctttcgtggctctccctttgaggtggtcacgctcggtcctgtgactatagtgtaccacagtgctgtttagaaaatgacttcctcggccctgaaatggaccacagtgtcctgaaagccctaactcatcacatagaagttatcagtccattgcagggaggttctttaagaaaatgaagggataatggcaatgatggcatggccatctagatggacttccttctagtgtccgtattgggacctgattgaattattcactgctgacacaagccctctacacaagttaaaaattcagcaaaaatacacaaaagccatactagagacctttaaagtttctgtatggtgaagtcatcagcatttatcgcagactgtacctagtctttctttctggaatgttcttcctccatccatctgcctggttatttcttacttggctttttaagatgaagctcaggtgtcacttccttcaggaatgcttctctgatccccacaacatggacaaagtccctttttagtaaatttgtgtgatcgtgtgtaatcatctagaaaaaaaatgcttagcttatcatattgaaagaatatgttttcctgttaatcttcccactaaccatctgagggccacttcggggtatcgtttgagaggtcagcattgtaatggtaaatctgaaatggtaaagagtaaaatgaagtattttatttttattgtatttttgcctttgaggcaagatagagtagcagaaggagcaggggctgaggttttactccaagctttcctatgttcttcttctgtgactcaacctctctaaattttattttctttcactgtgaagtcacatgccagcaccaaagttagggaagattcctgagaatggtctaaaggttaataagatactgcccagcaaatatttggtgttccataaagtttcataaagcatacctcagatggacaatgatggggaaataggtttgttaacagtggacatgcatccatttacttgttctccctataaacaatttttttttttgagacagagtctcactctgtcatcacccaggctggactgcagtggcaggatcccagctgattgaaacctccgcctcctgggttcaagcaatttttgtgccttggcctcctgatgtagctgggattacaggcatatgccaccaagcctggctaatttttagtagaggcagggtttcaccatgttggccaggctggtttcaaacttctggccttaagcaatctgcccacctcggcctcccaaggtgctgataaacattttactgagcatgtacaatatgccagccacagggaatctacatgtgtacatcatacctgtgtgatgtacctctagaagtttgtagtctagaggaggcctgacatcccagcagcttctatggtggctaatgtaagaagccccacaaaagagggggatgattcattgtctacagaaatcagggagttcttcacagcagagtccaccctccagtggggtctgaaagagtgagtaagagatctctgcacagacgagatggagaaggaggcagtgttacttactgaggcatgaaggctcgtgttggggtggcatggatattgatggagtgtaagatatgagagaacagtggcaggggacgatgatggagagacagacaagggtcaaggtgcagaaggcctttgtgccctgctgtggggtttggagttgatactgcaggcacagcagagccactgaatttagtgattggtaacgaaatagttaaattgagagtgctagaatgtctaaatgtgaagagtgatcatgtttatatagatttcttagctcctgccaagcctttttttttactttcttaatttggtattaaagttggaagtgattaataaagtgataacattactaatttttaaaacattctggtctcctggccttcacattgttttaatggactgtaaatgcttgcatgggcatgcttgttaaatgactaatgtggaatccattcattccttcaacatctatttattgagagcctgctctggactcttatagaccctgaggatggttagagtccctgcctggtggagcctccattgccatggggcagatggcaagactaataaatatataagggctatagaaattatggcatgggaagaacacagcagtgatggaggggtgaggggagtccttctttaaggaagtgctctctctacctgactatgaagaggagggattagtgcggggttccctgtttaggaaatcttaaatcttactgtttttccattgctgattttaacgttcttggagtttagtaagtagtaggttctcctctcttttctctctctctctctcaaaggcaaaatgaaaactatatttatcaccacttatggggcacgtctgaagttcgctgtaggaaaataaattttctaccttacaaatatttctttgctgggatttatgcagaaggtttatgatagccagtttctaatctagaaatcacagaattggatttgagaataaaagcatcttttttttcccctttcacttcaaaaagaacacttaacactctttctcttttttcaattgagtccctactctgtgcttggttttgtgctaagtgctttatgcatacaatctctcaactcctcaacatgtctctgtgagatatgcatcatcatcttcgttttgtaactgaggacattgagactcagggagattttgctgatctgccaaggtttgtggctcctaacgtcaagtctgcctcaggacagtcatgtcctaactactgtgccttcctgccctcccctatggcctggtttcatttcttcctttgtttattctcctgtgaccctctctgtctaaatattttctttctctccctcattcatttggcaaatgtcatctattgagatggcaaacatacccagactgctgggcagtcactgggaggggatattcaggcttcaatggaggggactggacccatattgagttctgaaacatggacaaagtcagaaacgagggccaatggccttgtctccaagagtggttttcagtgagatggatgctgccccggccagttttcaagggacacagattgacctcacttctgaatctcaacagacaggatggagaggggtctccatgtctggcacttcatgtactttgtctcgcttagttttatccatggaaacatttggtagatgtcattgaccctttctgcacataaagaactggaggctcagagaggttatgtgacttgcccaaagctgcaaggctgttccaggtggtactgatttcaacacacagctcatttccagaatccaaaatcttagtgctggagctgtcattctcaaagtggatcccttagaacactagcattggggaaaaggctggtttctgtagtccagtgtagcaaatggagctttccatagcccgtcttggagaaacacattctgcgtcagcatattatagggtccataggaatcttttaattctatttaaaccagattcacaaagtgtatttaaccacagaaatcttttcaaaagaaatagtcactaacataatgagaaactagcgcatggaataatgacatacaccttactgtctccccagttgtaattttggtagagagaggatgaagagagagaggttaggaaggaaaaaagaagacaaaaagaaaaaaagacagtggtggaaggaaaagggacacaggaggtactcaaatatttcacaataaaattctaaaataccttgtcagtttttcttttatttccgagccttctttcttgtgcttttcaaattggtacacaaatgtttccctaagtatataagatgagatagaaagattaatctctttgggctgatgacagtcttaaataatggtccatgaggctgagagaggccgtctgtgcaggtgaccaagccctaacaccaagatgtgggagctgagaggtggcatagggcctgggcctagaggcacctgctcctctccctcattgcccagagagaatcgaatctgctttccttggctcccacagcaaggaggtgacagagcggggacaactccagcctcttgactcccagcccagtgtgtttttccctgcagcacatttattttttttcagagtctgtcttatgctcacatattattttccctgttatgcttagcccatcagcatttgcttagccagagatattgccagcaacataaaccataaagattgtaatttgcctggtttattgcttgctacagtccacagactcttggcgtaacctaggacgggcttctcctgcatatttcttttgctcttggttctttgaatagaatgtgtatataatttggaatcaagacaaatttataatcaatattgatatttttctcttataaatatgcatatattcctaatcagatatttaaatggacttcctgggttgttatggatatttttattaaacattttatagtttatgcagatataagagtgacaatatgtatacagtttatatttagttgctgttagacccttgctctcaaaatgtggtccttggaccaatatcacttaggaactttttcaaaatacagatctggggcctcatcccagacctactgaattcaaatctgaattttaatgaaattctcaggtgatttatatgctctttaaaatttgagaagccctgatctagagtacacaaaaaacattaaggccagtcttcgttttgttcatgcccatttttcccagttgcacatttatatctttgacagagtgcaacagctctgcacttttcatcttagaaacttcattgtgggctgttttctacattattacctaagagagtatctataaagcatctctgaggcacacagttggtacctgtctatctatccaactagatggatagataggtaggtagagagatagatatagatataaatataaatatagatacagactgtttaaaagctttattatttatttatttattttttcttttgagacagagtctcactctgtcgcccaggctggagtgcagcagcatgatctcagctcactgcaacctctgcctcccaggttcaagcgattcttatgcctcagtctcctgagtagctgagattacaggcatgtgccaccacacccagctaatttttatatttttagtagagatggagtttcaccatgttggccaggctggtgtcgaactcctgacctcaagtgatccgcccaccttggcttcccaatgtgctgggattacaggtgtgagccaccatgtctggcctgtttcttaaaagctttattaaaaactatgaaatgtctaagatcttaccctactttcaagctaacaagttagcctgccatgatttcatagatgatggcagaagacatgagattttggggtcagagacagaggactctattacttttacacagcatgtggcatgaacagcatatttgtatcaattctctcttccaaaaccccatgagtgtgaggcaggtgggacccaatggatgcctgcacattctctggattgtgttataggagaggaaccctgaatttagggaatctgaatcttttaaaatggacagtaattatgcctgctctttgttttggagacactttattttggaaggctgttcactatacaaacatctttgaaaagataatccaaaacaaagggcagtcagtacctttctttgtgagatatacagaagtgctagagagaactgtctcctcctaataggtattagaacatctttatcattgggttttaggaccaataaatattttctggtggccatggaagatatatttcctaatacctagattgtactcatggttgtttctatcagaaactttgaggggaaacttccagtctgggcattcagttaagccccttacaggaaaagagaagttatagaaaggaaacaagtggggttgtgcatcataaatagtagagtcactggtagctcttcctagtgttggttgtcccattttagtacagaacctcctcttattctcaagatgagagatgtgacaccgttcagagaactctggagaaactctaacggatgtttacaagattggaaaatagtagtaggaagaaaagcagagataaattggggttaataatcattttctaatacagtagtcttgttgtccctaaatgggttatcatgcaaaacagttaatttccctttgctctgggtgtccacaaagagcctgaaactttcagaaatattgtagaacagatttcttctttgactcagagtgtttctcagctctcaaagaacaagagagtttggagaaggaaaaacgaatagttttacacagcatatgacaatagtatgctgagaaatgttcaggaactagtactcaaggatacagtggggttggggtcctaatttgtaatgtttgctgatttccgcggtgtaaacattcccaccatgaagtcagccagctcaaaaaagtcctgaaaattagacaaagaagtacgagctgtctctagcaagccattgcaaaacagtcataattagcaatttttcgacagtgaaggtagtttgatcatgcaagaggtttgtttgtagaaactcttttttgcaagaccttttaaaataatatatgttctctttgcccccggtgattcaagctagatttaccttaaggtaggatgacagcctacatgatcttttgaagttcgtttcaacagtgcaatttgatttttcgaaaaagctttcctgtctggtgcagtggctcacgcctgtaatgtcaacattttgggaggcagaagcgggtggactgcttgagctcaggagttcgagaccagcctgggcaaaatgacaaagcgctgtccctataaaaagttacaaaaattagcccagagtggtggcgggcacctgtcgtcccagctacttaggggactggggtgagagaatcgcttgagcctgggaggcagaggttgcagagagccgagatcataccactgtactccatcctgggtgacagattaagaccctgtctaaataaacaaaaacaaaaacaaagccttccttaaattgtgggtttaactagctgatttgcttcctttaaataaattggccaccagctcagcttatttctctcctatggaagggcctgtaggtgcagtctgattgtcactgatatttttagagaagcaggaggttattcagacttaaccaaccagtgatgattccttatacttgggttatatgtagaaccgtagtgaattacaactttggacacaaggtgcctgcatcgttggttggactgagatcatggtaaatcttctctgcactaatgaggctttgtgcctcttcaagagacttaccctggaattccctctgggctcagtttggctgtcgattctgtaaagtccctctctggagggctctattgctgtgttgacagcaacattttcccagagaatataacagtggcccacacactgcagcttcagtgaagctcatgatgagtaagcctccctcctgcctgaactgtgcagttcccgctggtggactgtgccttcacggacaccgtgcaatgtccctatcttctggtgtgtccgtgcctgtcatgtggagtttgatacagtggactgatttcttctctgctgtgtcctctccctcctcaatgttgagggatatgtggagagagcaaacttgctgcacttagcccaccccagtgagatgcccttttcatggccttaacaggctggtcttttcttctcccagcatttaacagaagggaggacctcgactttaatgcagatttgagtgcctccttccctctcccttgggtaatattgattagaaggcttcaattacttatttatcagatttataaaatgcttatcttgccaaggtctctgggcacatggacaagagtaaaaataaacaacaagcaataataataataaaaatccaccaaacataggtgctcattctgaaggctctacatgaatgccattggaagcctggtgacattgatttagagcttccattaccacttgactttttttttcttttctttttataaaacacacccacgtccaagggggcttgttctcctgcataaagcaaatgcattaacaagcaaagagatggaacacatagatttgctgttgaggctaaggccaaattgcaaagaactcatatgccatgttgcagagatcagtttccaaccccctcatcttttcttttgtggtgaaggcaaaaatagaagtgaatcttaaaagagggctttgtattgtctgtcccaaatttttgtctagacacactgagacaaattagcttcaaaagagttttcttgttctgcaaaaggggcagaattctctgaggagggtgtgctatgtcatgccgtagggttgctgcacctttttttgtttttttgacactgacacaagaacatcacagtagttgtgggttgtttaaaggcttagctgtgtgctgatgatattgtttctcctcaactgttcaagatcaagaaggtgaggcatttaattagatcagaaaagagtgagcaagtttgaagaacttttctcaacctgtcagatctgaaatcttaattccatgctggactttctctctggagaagcctccttctgtattcctgtttacttctgataagagtaaacaaatggtagaaatgctaaaagggaaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgtttgtttttgtaaataaagttttattggaatacagccccattcattcatttatggattatctatggctgctttcatggtacagcagcagagttgagtagctgtgacagagaccttatgtctcagaaaacctaaaatgtttactctctggcccttcacagaaaaggtttgctgacccctgccttaatggaacacataagcaaaatatctaatgaaataaccatccacctcccggacttccacatattttgtaataggttgtggagatggggatcttgcccggttcagcttctctgttttagtcaggccagtccctaaatcaacgtaggcagatgcacaagcagtgagatgggagcagaagttcaaacttaggggaataccaaggtccagctctgcgcaactttaccttaagagtctgtgattccctctgtgtacacttccatttcatatactaacatgggtactgtgtaaaaagagaaagagacaccttcaaagctaccatcaggggtagcgaatggtgctagacctcactggtccatagttcctacttgattaggtctcagttaagagctagtatattagatggttatacatggaaacataggtggatgttttttcctctctaaaagaaagctatgagctatgaagttttctggcttggatgggtcagtgataatttcgggggtatggcagactttgtgatattttcttgggaagtaaaagaaaaaaggtatggttctgataaagattctgtcaggaattctatatttgagtcttttttttgttataacatcacactaattttttttatacaaaagactgtcagggttcagggtgcaaaagggtaaatgtgcagtctttgtatgttccattgtcttttcttcctctcttcataacttttgcagagaaggccagccttgtttgtatgttccggtgtccaaaccttatgtgtacaaagtaactgtgtggttcagtcagaagaaaggtgataggagttttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaacttcgccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctataggaaacggaactgtgaagaagcagaggttgctggcacgttctgcggctctcccctctgccccgtcatacctagctttgctgtggctgtcgctctagcagaaaagctgtggtattttttctgcctctgcaattttcccacttggatggagcctttggaaatgaaaaaaacaaataatcaagagccatcttgtattgaaagctgatgttctgcatacttaatgggctgaatcaccctttcccttttcagatatggctcatgtccattaagccgtggatatggctgataaataccattgtacttgtcatatcaccaagtgccacattttccgaggcagtgacgtttctttacctcagcatttgtgagagattgcactctggagtataacggttcaggctgaagttgtctattaacttgaaaggacttagagatatgttaatggctgggtgggaactcagttctttagaaattcttcttaaaccagtacctttcatcaagtcacgatgcttaatcttatgttatccgtggcttatgtcctgaagtgggtgggaaatggggcttgacttccccaaatgtaagaagtgtaatatacaatacttctcacatatgagagatcaagagaaactactgaagcttccagtagatattccagaacttgtttctttgataagaaataggctgttctcctactgtgaatgtcctctcgctgtcccacctcccagcatgagagacccctaaaatataatgcaacaaatgctcttaatgacattgcctctcacagatgtttatttagaagaactgtgaagggtgacctgtgaagggacattttgtgtgtctagggattgactttcccttcttgacagtgctctttatcacaatgtatttttgtatctgtatcacatttttgtgtctgtattgcaatgtatattttgttgaaatggttttggactctaaacagggttacccagcttgatcactcacgttctttacttgacttggctctgaataattctcagacatttcctgagtcagattcatccctgaagggttagtatctactgtcagggatttcaacttaattttattcactttcagatatgtgtctgtatcaggcattgggttagatggtcctatttcccagggaatgacactttggagggaaaatgtgaagtcagtggatactttaaatagagtttgaaaggtgcctagaaaatggtcctcagagatgggcattgaaggaggctttgggatttgcagagtgtgagagttggggaaagagcatggagaagagagagggatggattccaggtagaaattttatgtcccaagatgtgaaagtgtaagaaaatgtgtggcattcatacatttgctaggagtctggtttggcttgagcagagaacgggggtagagaattgggagaagagactgctgggttgtgggggcagggcatgaagggggctagggagttgacagtatggacagaatttatcccaaagacttcgcatggaggagtaccctaattaagtgtatgctatagaaagaagacttggcagcatgaggagatggaggttggaagactggggtgtgatgggaggtgggactgccactgggttagatcaagttcaaataactcagtctaatattagcaggctgtaaaggtaagattagaaaatgaatcccaaaaatgttgtgggcaaaggcagcaaggttgaaagaagctgtatggcctgagggaaaggcagaggggagtcagatgagtctgagttcaaaacctagcactgccggttactagttgtatgacctccaatagtctcacctgtctttaaattttttaaattgagaaataataattgtgcatatttatgagatacatagtgatgcgtgatacaaataatgcatagtgatcagatcagcatatccatcatctcaaatatttatcatttcttcatagtgggaatgttcaatatcttcctcccagctatttgaaactgtatgttattgttaactctagttccagtcctcacctttctttgctggctttccatcttctggacaatgggaatggtactctttcttcatggtgctgtggtggaagtgaaattagattatgcatgttacaggggtagagtttgatagtcactctttgaggacacatgagtgtgcctgtgtacatttgggtacgtgtatgaagaaaggagagacagaggacctccattcagacatcgattttctctgtgcttatttaaaactcttcattcacatgctgcacactcaacaaatacttatttagtggtacacacatgcaaggtgccagctaaggactctgttccctttagtgacatctcctgagggggtgagggcagaagatgtttaataaattaatgttggtcaactaattcatgcccacatatgatgacaaaagtgtctaatagccagtacaagtcaaaatactagaaaaccatccatctgagttattaacattttaatttagatcaatagggaaaaataagtccttagggggtttatttatatccttagtgagtgtttttttcttctcgcaatttagtttccttgagaactgaacatttataaagtgtttttggtgaacccatttatacagtagaattcattttctctaggaggttgggaactacagagagaaaccagagagtcataaattctatttaattcaagttcatgcatttcactagagaaagcaccttctttatcctcttattgtacttcccctgagacctctgaacagatgatgttagcagtgatttaaaaatgcaaatcatatcacagaagtcctttaaaggattgttcctcactcctcctcccaccctccatcacacaggcccttaaacaacaggaatggtaaattcaaaaccaaaacttgcgtcataggtaaaaaccaactatttgctgaaataggctgtaccagtctggctattttgatcacccatgatagttggaagacagaggatctatattctaaatctgatgaatgtatttactattcacattacatgtttgaggtgagcctgctatatgtacatgtggagaaagaagtgtggttataaggcaaaataaatagtagcccttgcagtcaagtggcttccgtggatcaagagctcgtataactcattttccagaagaagggcagatgcattgcagtgggagttcatagagaaagattactcttggctcatgctattgagatacttttatggaggaattagtttcaagttgtgcctcgaaaatattggcctgtagaatcttccagtttgagaagtccctaattacacagtgtttatgggcatgatttttaattgtgtactgcaccttatttcttcctatgagatttttattcattctttaataactcacactacatttgaaaactgttcttgggaggtatttaagaagagttgtgggactaactcttcttaaaacataaattttgagagtcagggatggctagtcattgtggacaaaggatgaactgaggttctttcattcccagccaagctggtgacttgcacacaagcgccatgctatcagagcctctccccaggcagtgtgcaccagaatttattgcaacctcagtgtgaaaggaactgagaaatcctttggcaacatgacctgggaattccaaaagtcgcccatgcctttgtataaaaccaaggaaaccagagcacattcagccactgtatgagcctgcagtcccttatgctgatccctgccaatcccatctcatctgagcctcacattcccacagtcccctgaagcttaatcaagttggtaaaatttatgtgtgttccttagaataaccatcacaacaattattgctattatttatggagcacttgcttgtttctaagcatgtttccatgcactttgcatgcattatcccatgtaataccctaaacaacctcatgagttaaacaatgagactgagatacgaagaggtgcagtaacctacctggcctcacctgtgtgtagggggtgagtggcaataccaggatccaagcctaggcttacaaatttgcagcgatcttcaagattattatttattttaattattcatttctctttgttcttgttgttattttgatccatctgtctctacttctggttcctttttgctgtttttctccaaaataggatatgttgttttctttatctcagtagacatcttttaattattttagcctaataatacttaagggggaaaaacaaaaaccctacgaaaagaaaagtattatcttaaaacttaaataggttcagtgggaaaaaatcttggttcagaggaaggctttatgttgcacatgtttgaattatggacttaccgctcccagtggccaccacgtgtgtgtgcttgcaaactcattttttgctttgagaaactgtggacatgtaagagtgaaggtggcagctctactacaaagaattttgcatgagtgatcctgaaaaatatgtcgaaaatccactctcgattttcatctttttaaattgacattttattgtccttgaaccaagaaagaagccattctgtttctctgctggttagacttttggaagcttgaaatggtgctatcaaagacaatgcagattaaaaaaaatgaccagtcaggtgggcgcggtggctcacacctataatcccagcactttgggaggtggaggcggatggatcaccagaggtcaggagttcaagatcagcctgaccaacatggtgaaaccccgtctctactaaaaatacaaaaattggccaggcgtggtggcaggcacctataatcccagctacgtgggaggctgaggcaggagaatcgcttgaacttgggaggtggaggttgcagtgagctgagatcacaccactgcactccagcctgggcgacaagaggaaaactccgtctaaaacaaacaaacaaacaaacaaaacaaacaaacaaacaaacaaaaaacaggcacaaaataatctcctgggtagcaacagagacaactaaacaaggtcaactcagtagactctagacccgggggacatgggttctagactgagttaatcactggctctttattcatccataaaattaggatgacatgaactgatccctcacttattcagggtaccaggtcatggcgaaatgctgctgcataaacagtaatgactctgtcaatggaggtgtcttagtaaactctctatattctttctcatctcatcttctcaaatattagaagtcaggcaaaaccctcattttcagttctaatgttcaccttattagctatgtgacctatggtgaatttcttaatatctcaaagcaaaataagtatttcttcaattgcaaaaataaatggtgataataatagctcctactgtatagagttgttgtgaggattaaataagggactatctataaatcccttggtatggtgggcaatatagtgtatggagaggtgatctaacttaccagtgaagagcaggactatggagacagacttctcgagtttgaatgctagctccagcatttaccaaatctgtggccttggtcatgttattcacctttctgtgcctcagtttcgcacctctaaaagggcataatcacaatgctacttataaggctattatgaggattaaatgaattaatatatgataagcacttagaagaaagctaaaaagcttggcatatggtttgtgccatgtatcaggtattactatggtacataataagcataagagtaacatccaataagtatattatcatcatcacgatcatcattatgttattacgttgtaattattgatcttggcgatccaaagcaaagtgactcatggagaatagttatacttagtagggacatgaaaatgaaattttaaaaattgggaaaataggaggaaaatgaaaatgaaattaacaaaaaagtataaattcagtagatgcagatcagagtcattgaaccagcctgtcatttctcaaacatgagctaagtgctgggactatagagaggagaaggtcatctttgagaagcacctggtgagtttgctgaaaagcaaacatcagagggcaatgtgacatgttgtgtcatcaatgtctatctgaggggttcagatgggggctcttccaccccagtcctagagaccagagcttgctttatgtagaagaagccacttgaacttggatgtagaggccaagagtctcccaggcagaacagtgggacaggaaattctgtgcagaggtttgagtgtgtgggatgagctcaaggtggggtgttctgtgggaacagcgtcctggatgatggagacacagcatgcatgaggagggggagcaaatggcagagtgggtgggggaattcgagaggtggcctgggatgggcctaaagtggatgttaggtagaagagggcttcctcagctttgcgagctaccttgagtttggtgcagggttccactcctcccagaccaggtggctacctcccaggcagtgagaaacaaggaattagaacacagcccacacccatccattaggaagtcattagcctagaggtaagtagcgcatcctctactttggctctgctgcgtgctcaccagagccaaagcttccgcttgttagctgggaagggcatagagaaaaagccattgagaaattgcttttaagggctttgtggtggccattgagagggtatttcagaggagtggcaaagcagaaaagccagctctcaaaccaagttgaagaacagctaggttctgatttgccaagagctgaggtatctgcctctcattcaatggcacgcagggggagagaagaaacagtgaggctaacagggacacacagagaggctactgcctgtcctcaggtatggctggaagagatgataacaccacagattggcctcaattcaagcaggttgtgaaatggctgagctgctggggaacagccagaagcctcggtgaggtgtactgaattaattgtatctgctccagatcttgagagcccagagccaattgtccagagcctttgccttcaagagttggaaggcagaatgtgctctgctgacctggccctcagaggcagctgcctacctgtccaccagcggaaaacaccgaggctcaaggtttggttagcaaagaaagacaagtttgaatgttagacctggaaaggggagtccaaggctgcctaggacagcttccttggggaagctgaggcccagcgtgacccatggacttgttaaaatcagcctggagtaaatagcagacctaaatccagaagaactggattttcctgatgctgcacatgtttcactatatgcgtctctgcagccttatccattctcccttagcccctctctctggtgcccttttttgccctctggccgcagagattgtcagtcaaatctaccttaaccctaagctttctgatcccttttctatcttcctacccataagagcatttcctgctcttttctcagagccttatttggtgattggtaactaaacagcttaagtgctagggtggcaatgtagtggatgtaggggatatgacattctattcctcctgggcaatacatttgccttttacaagataccttctcgctggattttcgttcaaatgttccacttattctcctgtctacattccaaactctatggtattgactggtgatgaagggaggtgatttgagaagggacattttttagtacggacatcctcctcagtgcatagacagactcttggtctgggaatctaagtggtctatatgccagtactctctcagagaacacttttagtcagaaaaatgaagtcaagcaaacgtttagtttaaaaaaatgaagtgcctaaagccttttatttgtcattaccttttaagtaaatttttaaggcagactaatcatcatccccacaaaagaggcaaagattatctatctctccaaggcagttattcagttgattgtggatgaatttttgtctggctgttctaagcagtggataatgaaaaaaagcagagccttcttattgaacattttgacaagagaaattttgctgttactcaccaagatgtaggagggatgcagagtcctggcttgggtgagggacgaggttgctgaatagacgaacataaaaggaatccattaatgatttagaggactgcttaatttccctacttctgtaaccaagaaacagagcttgatcaatactctcaaggtcactgttgctatttgctatgcctgctggtcttttttagagttttgaaaaccatcctatgcatccatcctgataaatatgctcagttttggtacagggagatatggttttaagtgtggggcagatgagatgcagaaggaagaagtgtagcctttctttgtgggaatctgtagggaaatctaccacaaaattttcagttcaagatagaacctggggacacaagagagaaactctccttgtgatagccaatctgttctgataaggcagttattattactaaaaggatccctggctataacgtggattttaaagaacattattcaatgtgtttcctcttcaattacttctgtgtcataatttagctagctgtttgccttcaaatgtggcattggccctgtgggcttgcctagtagttcacatcatattctgtttgttcacttttgtatttgttggctaagttgacttttttagaataaagattctctaacttactaatgtcagagctttttaacgctgatactgaccaaaataagtgaaatgttcttttggtaacttatgcaaaaagttttaatgactgcacaacatgacattcaaaatggcaaccaagacatgaaagggggcctgtcctgtgacccccatccctccaaaaaatggatttccaaagtcctctcattatttgaggactttgaccagaacacctagattaactcttggagttaattgcctttgcaattatatgtataattgcaggtatatataatatacttatattttcttatgtctggattaattaaaaaggaaaaaaatgagtcaactgactattgtctctgtagcattctaaagcaagccttggttccatgcagcctcagaagctaacagaacccgcagtggtaagggccattttaaaaagttcatctgcatagagttctcctagatgtgggcacaaggtgtttgggggtggggggcacagacaccctgaaaagttccagagaacacatgtggtttccagtcaaaatatcatgcaaatattttgaaatattttcttgaccacagtatttcttctttatacattgctcgtagaagtaatgttttgttatttatttagaaaaaaagcaaatggagaaattcctctttctgattggattttatggtcctatgtggcaacaccctagagattagaatctcatagtttagtgagaaagacttttttagaatgatctctgaatttgaaagacatctaaaacacaactcaagcttgaaaaatgtctagacttttttttaacagacgaggccactgggaatatggtaaaacaacaagagatggtttagtttcagatgggaatttatttcttttaagcttgtcaatgagcagacaggcatttgagggggagtctctttgtcctgtgattccccagcctgggaagagaaagttatttttattcccagttttcatcatggaatgttaaagaaaatctgactgttctttcattgagtgttgctgaattatcctcctggtttcaagtgtgaactacagcagcaattccactgtggaatattatgaacagagttaattataactgtttaatgaggcagatcccaattttcagtagatcatgacccttaatacattaaagaagagagacagttcacatttttattcaactgacatttgattaatatgcttcaaacaagttttggatatactgagataataatgaaatggactttatcctgttcataaaatgcctgtaataaaataaaaagtatcagtgttgttcttgttgttgactagctttctgatgtcagtttcaggttattaagggaaacttcagttaaaaatatcattggatttccctgaaggtcacaaagttagaacaaacactagccttcaccatcagtcaaattcagatgaaaattccttctctgccacctacttttgtccttgtacaataacaacaagaataatactaataataccatttactgagcaattatgagtttgagccatatgaacttgtcatttctgtaagctaagacagtggtcaaacgtagacattttcatatggttcagcctaatacatatactgaggcactgtactaaggctgtgtagatgtcatctcaattgattctttcaacacagttttaaggcaaatataataatcaccatttaaaaataagaatatctggccttacacaagattaagaaagttgcccaaggtcacaaattagtaaaatgaagacttaaaactgagctatcttaggacctcaattttctctagtcacactataaaatagatattatataacttcccctagtcttaatttcctctgattgggaggtgcttctcatggtgaccaagatgtagtggttgctacataatgtgtagctgtaactaccatcagtatcatcaccatcatcaccatcattatcatcagggcctaaagtttcacttgctcaaggctgtgtacagagcgtgcacagttagagaatgaagagatgcaactggtgtgtacgtgtgtgttggtgggggtggttgctgagaggtcttttctctatttgcagtcacttcttgcaaaagccattgtgtttgagctgaacacttgcacatgcattttgcccactttgctattttcaaaacaaaagagaaattggaagaaaataccatattgagaacagaggtgcctgtgacaaattggattaattgaaaacaatccaaaaaaaaaaattgccccagttagtaggagagtggagatcaaattagccatggagaatctaagtagaggattttattgattgctgtcggcataacctaaattgcagaatgtgagtcatcatgaaagcactactatgtctgcactgataattgagaggctgcatttttcatatggtcaagttggagatagtgagtgtggccacctggaatcttcccaaccgagtcccacaaacacctcactgcctcagccacctgccccatgcattcgcttcccaaggcacaaacacagatgataattttacaaaatatagtttttaaatggttgttttcctggatttgatttgatgtgcagcatacatgtagacttacactatgcagactgagctattttaatgagaaagaatgaagcatttccattttgttctatttcagagggagggaagaacaaataattctgttgttgctcgcagaaatgactataagacaggggtcagtacactgcagcccatgggccaaatatagttctataaataaagttttattggaatacagccacgtccatttgtttacatattgtcgatgcctgctcttgctctaaaacagcagagttgagtgactgctatggagcacatatcgaaggcagaactggaaatcctaattatctggccctttgcagaaaaaactgtgctgacctcttctatgcaaaatggagtggttttagacaactaagttgactttgtataagctcaagctgcctttgttttgtgtctagtgttgcaagtttggcagtgaggtttggggatctcaggtgttgacatgtatatctgccaggacgctgaaaatgtctacatccaggagtattttagccttcacctacagcatttggcagtagatacgaaccacatgttcagagagagagatttaatctatgaaaatacaaaattacaaggagattaggaagaagttgcctagaaataggcaggagccatcacccgaaaatgggggcatccttgtccgtggccgttggtgcatttgcttatatggacaggggcataggttgcaggttgctcttcattttcctttctgggagacagagaggaaataggattaaaaggcagttcagatgagttaacatcatggcatagccaaaaaaccccagtgtaatgcaatactctttatacttagatatagctgagtttttattggctgtttggaattgggcatgttacttatcatctcagcggttttctcatctccaatatggaaataaaatacactttaaatgagctatgtataaaatgtgccttgcgcaatacagaatatagttagatgcataaaaatgttagttactctccctttttattgtctttcctctgtcacacacagagctttataattatggtagaggggcatatagtcaaaggaggggaaattcttgcatataaagggactttgggagtctaggacagaggttgaacctaatgctaagtaggttggaatttttttctccatgtcttgatctaaaaagaaatcacagaaatctcacctttatgtgtttccacctctctatatttggtaagaagataacatctcagtaaaatgaaatggtagacagaagcacaatctcatcaaagctgtgactgggaaaaatactgaaactcctccctagcctgggacttggaaacatctactgtcttaattccccctgtgccctccaccccccaaattaatgtctaccttgagctctcagctctgtccacgacagagagcttcatgtagtcgtttccaggtgaattggtcaaaactgggattatattccgactgcaagcataggcaagttcagggatctatctgttctctccaaagacagagggaagtgggaggacctcctgaggggtggtggcagctttcctgcatctactgaaacctactttgtcctgctgccaggtctttgctgttggcctctgccctaggtgcctccactgctgacactttcagacctgccgtgacccccaacactaagaccacataggctgtcccgtgtacccctcatcccaacacgcccagggacagtcttggccacgtctgtgcctcttttggggacagaggaactatggatgttctaacttactgccctgggctcttgggaaacgcgagggctgagtgaggtccctgcacatgctggtgcaggccgagcacagtgcagtctttcttctttcactggcactgagaagaggggacctatgtgtggctgctgcttcccagaggtctttatgggaagcagccccaggtctcttcaactctcaatcttcaaatgtcaagggggttctattgtttctcactgaccccaggagttagcctgagggttcgggcccccacagtgcctcatcctcagcgtctaactcactaaggtatctgctcacagtatagcttttctctgtgcagagctctcctctcccggaccccaaagtattttggctccttgctcatgcacctgagtacatcctccctctcttggccactgccatggccctttaagggaggtttggctgctctcctatggctctgttgggctgcaagtatgtaatatggacccttgcaccttgcatagagttccaggtgctatatagatgtcacaatgtcacttcaaagctgattacttttcttttttttttttttggtagtagctaagattctttaatttatagttgaccacatccctgctccctatctcacagaactgacgccaaggcctccatgaattgtgtcacatgggattgcattagctactgcaaccaacaaataaaaacagcaaccacttaaacagataggtttttttcgcacagcaagaattctgggatccagggttattaaggtggcttaatgttatcagggacattctggctctttccacctttcatatctgctatcctcagcatctaggccttctcctcttgtttgtgacctagtggtctcaaaaaggctgctttgcctcaagaccttaaaactatatcccaactagaaagaatgaagaaggataaggaggctttttcttttaattcaagattagaagatccttcccccttaccttctagctatatctcagtggccagagttatgtcacgagcccacacttagtttcaagaggtgctgggaaaaagtatattggatcctttccatccagggtagaggaagacaaaggaaagggggtttgtgaatggattttgaacagccaatctacaatatctgccaaaggtcagacagaggtccttagacagagagcagtaaagctatttcaaaagatggtattaatctatgatgtcataggattacaatttatttagcttttctgaaagttcaaaaactcttgctgattcagatcattaatttagtgaggaattgggttggtggaatattagggtatctttcatgaacaaaggaatttctaaattaatgactagtggaaacaagatgggtggtaggaatcatatatcaccatcttaggaaacaaactttttaagcattttcaaaggaatctcatgaaaacaattgatgaatcatataatcttaaattatttttttcttttgggtaaggctgaattaccccctacttgccaaaacatgctggaaatgttttattggcttaattttgattcctttatatatatgaaagtaataaagctgcatttctttaaatatatttcctaacttagagctttcataaattcacactggcttttatttctagtcttaataaattagattctaccgcatattgaatataccctgttaagtatattgaaacagtacgatgttcactgaaggaggaagcttaacatgggaaaaattaaagaaataaagagagcatcaggcaggtggttgcattacccaaaggtgagcaaattacagcccctgggccagatctcacctgctatctatttttcataaatttaagttttactggaacacaccgactcatttctcacatgttgtctatgttgctttcatactacaatggcagaatgagcagttgtggcagaaatggaatgacctgaaaatttgaaaattatttactatttgtccctttgcagaaaaagtttggtgatacctgcataactagttatgggggattccgtgaaagctgaacacagtgactggatccctcttctcttcatgtggaaattactttaatgtttaagtaaagtaacataataattactattattattactataataatgtatatataatatatatattatatatactatatattatatatattatatatactatatatactatatattatatataatatatatactatatattatatattatatatactataataatatatatattatatattatatattatatatactataatatatatattatatatactataataatatatatattatatattatatatactataatatatattatatatactataataatatatatattatatattatatatactataataatatatatattatatattatatatactataataacatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgagatcaaggcaccagcagattcattgtcaggtgagggcccattttctggttcgtagatggcaccttctcattgtgtcttcatctggtggaaggagcgcatgagctcccttgggcctcttttgtgaggacattaatttcattcatgagggctccaccctcatgacctagttattatacctcccaaatgccccacctgttaatatcatcacactgggaattaggtttcagcatatgaattttaggaggacacacacattcagaccataggaggggtattaattttcatatcaaaacaatgggttctgtttctgtcttcagctttagcctgtcatgaaagatggtctcaccatattgtatttcattctagcactgagtctgctgctgacacaatgacaggggccctgagtctgcccttggctggccctgtgccctggagcaagttacttaacctctcagaaacttaccttccttatgtcctaagtgaaagggtgatattgactgaagaaaatgggctatagggtctccaaatttcctttcttcacaaaagttcccggatacagtgataagacagcctatttcttatctgacacagatgattatttttatttacaatctcaacctgaattgtcttttccgtttggtgcgtatgttgaccagtgtgtcctaacaaagtagatctgtttcattcatttgcaactctttgtgaacataaagcatttgccacttcaaggacaaaagctgagacctaggtctgcagataatggaaacagctgatatttactgaacacctgctatatgccagacacttctaagtgctatatatatatatgcttatttaatctgcacattagccccaaattaagtattatcattagctccattttataggcaagaaaactgaggcaacttgcccaaggtcacacagtcatttgggtattccaccttcagggcccattctttcaaccactcttctttctgcctctcagtgggtcaggctttagcacagtggctgttctccatcttcacatcaatcaaggggaaaaacaggtatgagagatgcaggttggcattcctagaaattatgacacttgaaaattagaacaagactttcattcaccaaagatctactctgtgccttcaagatcatgcttcaaggctccttttctcagcctgctgttctcctaagtcagataaaaaaaaaattaggatgatagtggcaatgcaggttggaaactgggtcatttttctgaaatcatctttctttgccaatgccatttttgaattctttctgagaattaaaaaacaaacaagcaaacaaccgatgtggaacaatctgtggcagatggttatttcagctctaggtgagtttttgtcattatattctgggaagtggaaattattactttagataatcatctgttattttagtgaactgccagctaggaactattgtagctatacgggtttaggatggggatttttttttttcctagagattaggacataaattattttcatttgaattctgtggaatttttgatgttcagcatgggagggcattttcactatagttccttgctatgagaatgatctctggcatagaagaattggtattccgtgccattctactgaatataaacaagaaatctaacagttcagttgggggtgggagaggtgagatgaaattaggcttaaagaacaagttagcccacttttcaaggtttagcttcccctggaaaatacagcaataaacatctaaaccatggtattcattaccaacgcaagtccctaattaatttattttatgttaattaagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagagtatgtgttcctggaggcactcctctcgcctttggacagctagttctgttgtctagaacaactggaagccgaagctctatcaagatatagtttctttcttttttttttttgagacggagtctcgctctgtcgcccaggctggagtgcaatggcatgatttaggcccactgcaacctgtgcctcctgggttcaagtgattcttccggcctcagtctccggagtagctgggattacaggcacctgccatcacaccagctaattttgtatttttgtagagatggggttttaccatgttggccaggctggtcttgaactcctgacctcaggtgatctgcctgcctcggcctcccaaagtgctgggattacagatgtgggccaccgtgcctggccaagatgtagttttataattaccacctatgtgtatattcctcagtcgaggaatgcagagtcaattccacaataaaggatagaggcaaaccccttttgcaaaacatttccttgtggtcccagaattggaactaaagccatggaacagttctcagaccctttctaccatgggtgtgaaatcactggcatttgccagcattcagacacagagtgatatcagcagccaggacccaccatttggctggaaggacatcttacctcccgagaggggtcaagagggcatgagcccaccctgtaggtctctcaagctggggttctggggccttcctccaggaacctaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgctcgtgcctgcgaatggaaagctggaaggcactgaggtactcacattagttctggttatcagaacctgttagattttttttcatctctattgtaaagttggataactgaggttcagagaggtcccctcacttggccagcatcacatagctcaggagggaaagggataggatccaaacgggtgtttctggttttagactgcttcttgctgcctaaccagcggcaggtgggtttctttcaggcatcactgtagaaatgaatcctttagcacgaaatgcgtggaatgactgtactttttaaaattcaaattccagtggtactagttagtacagacagtccctgacttaggatggttcaacttagaattttttaactttatgatcatgcagtggtgatgagcattcagtagaaagtggttcggtattctcctgtgacgctgagcaggggcagcaagccacatctctcagtcagccacaggattcagagggtaaacaactgagaccctacaaggttttgtgttgccgggtgattttgcccggttgtaggcaaatataagtgtctgagcagttttaaggcaggccaggctatgctatgatgtttggtaggctaggtgtattaaatacattttcaacgtactatattttcagctcatgatgggtttattaggacataatcccatcatcaattaaagagcttctgtttagttctgggatcttggacagttaaatgatggatggtaaatggccataattgtgatgaatgaaaggaaaattaatatataatccagtcattcctgctatacccatgtaattacactgtgtcttttcatctatgtgacattttaaattttttactgctttcgcagaaggaaatgcatttgtccatcacatgtttttcaaggcctcttgttctttaaggagatgatgattccttttttaagctaagaatttgcatcgggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgccctttagaatccagggttttcctcatatataaattccacttgaaccaaagaattatgaagggacttcctgcgctccaacatgaaggagtcgaggagaagagagaatccttcagaaagaggtgttgctgtgtaaaaccactgaggttggcacacgccccgctgctgtaagacattgttgagcattaggaaagacagtgaggtgggatgacttagcagcatgggcttattccaaaatgagctctttgagcaaataaaaatgtccctgacagcagaggcttctagaactgtgggttaatttaactcaagtgaggggttctgttggctgcctcagtcggaacatatataaggctgtgaccctgggattggctttgcacttttcaagtttcctattgagaatctgctttcagatagagtaagctctctgttttaatggggctttttgaaatgggtcacctgctaagcttaaggagtgtgcatagtgatctgccgttgacagtatcctgagggtgccaccagatgtggaaaagctttaggagcgtggattctgtgctcatgacgtgaatgagtgggttctcttgaagactgatgaacaattcagggatctgcccttataaaccttgctgggataagacacgatcactggggtttaagttgggtatgcctcccaggatctgatctatgactttcaatttctcttacagagaaatgtcaattaatgccccaggtggactgacaaagggcaggatgatcaccatttcaacctaagcttccccagataccaacagagtgccaaatgagtctgtgcccaccctgctgtggaggagaggcacattttaattctcactgtagctaggtaatgtctgagatgatggaagttctactaatggttgctcctgggaacaggcactagagaaaaaggggatgtctgggtaaagaaccttctttcttcctcataatcctcctctgttttcaagtttgggcacatccatttctttggtaaaaagctgaagccagagaagtgtctttgaagcctggaagctccctgctctgtggccaccctccccatcaggggtcacacatctgcctgcagcagcgtcagaagcagatatgcggccctaccttggtctgggagcaggagctggagcagtgggctgttaatgtcctcacttgtgggggtgggcagtgaggaggaggcaataaggcagcagcacatggggagagggataccctccgtgggtctggggatgaccacttgaactaggttccttgaaaagccacagttcagtcctctgaatgaggacttcagcagtttcaccttgtgggctccagatcataggatgttggcctaccttccaagaagtccctggccaaacggaacccaggccttgcattttatcccactctcaggcagagttgggtaattcatgttttttgtagtcagttcatggggattattagccccacatatgtatgtttcgcattccggaatacttgctgcttagctgaggtttcattatcttttgctcttagctaatttaaatggagatgggatttatcaggtacctgtattcaagtgagggtaatttgtttgaccctcttctagcttaattggtactgctggtggatttgacttttgggacttgcagcaataggcagagacatcggccacacataagcccccctgattgttgctatcttaacacgaatactaaatgttaaagatctccaaactctatttctgaagtattgcttgggatgcctgatgaaaaagtgttgcttcatgacaaattttattttcacctacactctttcttctagggtcagcttaaacttggacctggatttatcttcctgttttggaggcttattatctctgtttttactcttcaataattgtgttcagtctctgaacatgcttgaggggtctgaggcgcatcaataccaaccactttaaaaaaaaatttctcctcctcctcttcctctttctatctcttgattttcatctcccccacaatcattatcgtcatcctcacacaggcactggctgacctatgtgtacttcttttatgtgttttgttgtacattatttactttgtacaaattgattcccagatccactttggtcaatggcctacagtttcagccaaaattgggcagagccaagcaactcacattgtgtatatctgaggttcttgcagattttatatagttataggttgaattgggtaatggatttatatcattaacctcttgtttggactctgcaagtttcagcactctggcttcatatactataaagaactggctagagtattttgacgaaaataaattgaggcacaagatctatggtggcagcagcaactgcatactcttctgtgatgacatatattgcttatctgtactgactatttgaatcactgataagcccctctagacttagaattgtggaatgacatctttaagaaaatgtcatttcactctacagatatcgaccctatagatttttcaatatatgtttattgaagcaagacagaaaggctagacacagcccaggagaacaatagattaatttgggtgtctccatgtggtagtagtaaagccttttgagcatctgagtacctctcaaaccacaaattcttctttctttttctctactccacttaaagcaattttaggtgattctgtggatggggcaatggtatcagtctttggatgcattccccatcctctgtgaagtctctgaaatggtagttgttgagtcctcggacacttgtcatcagagcctgctgattagagcacattccccttagaattgttgagttttaactgtgcaataactttggctttccttacaaattccagctttgccaagtgtgctttctactttcattttcagctcataatgaaacttcattttgcaacatcagaccagagcttttcctttaaaagccttcctgaccatctcagtaattttagtttttcacctccagctaataaatggaccacgtttttttccctttgtcccgcatacactactgtaattttgatcaaagtgagaattagaataaaccaagtctagcaccttttccccagtagattaaaatgctccaggaagtactcactgtgtgtccacgtgtctaactctgcagccttcactatacttctgagaaaaatgtgatttcgtactggaagctttggaatgcctggactcacccagttgccaatgagaagcagtagatcctgcattgtgttgcatccttcattctccttcaattcagttgggttgttgagtacactgaagtttgctatggtttgaatgtttgtcccctctgaaactcatgttgaaacttaacccccaatgtggcagtatagagagttgaggcctttaagaaataattgggtcatgaggcctctgccctcatgaatagatgggttcattcatggctcagtggattaatggattgtcacaggagtgggactggtggctttatacaaagagtaagagacagctgtactagcacactcagcctcctgggcatgtcatgccctgtactgcctttgaactctgcaaagatttcccaccagcaagaaggccctcacaagatacagccccttgaccttggacttgtcagcctccataactgtaagaaataaattccttttctttataaattacccagtttcagatattctgttataagcaacagaaaacagactaagacaaataaaactcaacatttagaccttactattgtgaaaccaaaaatgccttcagctcttggtatttgtgtgaggccatgttgagcatagaaaatgtatagatgtgctccctctgtcctcctgtgggatgaagtctgagatggagggaaatcaaaataaaataaacacaagttttaaaaggtacaaaagaaggtccatgagtggaagtgaatgcttcagaagtttagaggagggtgaagtaggtacttgcaggagaaggcttttgcactggatcttgaagaatagtctgagcgtctcaaaggagagctcatttggtgggaggagatccaggagaagggataatatgtggacaaagtaaatccttgggaagcaaaaggggtgttttagggatgtttaagcaacttctggattgagcacagagaagaaaggaccaggaccaagaccaggacctaaatttatatatggggagatttctgctacaggtgcagatgatacctttgccaaagagggactgacaattccgaggctctgagtttagatttcagctctctcattcattcttgggtgaccttggacaattcatattcaccatgtgagttgagccagttatctataaaatagaaaaagcgacaacagcaagggatagttggtgcagcaaccaacagatataaagtgctccacaaatatcaaattaagacaataggtgtttaagcccagatgctgaacaaagcacaactgtaccttgctcacatctcactttgtgatggaaagtttttgaacccactgtattctagacacacgatgttatgagaacataggagtttattatttcattttacctagtaaacattttccagaagacttaaaaggcatttgttttgctttccaatgaaggtgagctgctaccttggtgccccatccaccagatcatctccaatggcaccatgccacgcagatgctcaagttggcagttttctgcttgaactctcccaatgacaaatgtgataagatttgcttttttagatagcagctgcatctttcttccgttcccttcacttcctttgggctcagcagttttcctttttgctccagataaattgctgttaatttaaatgtactgcagatccttgccattttatggctgattgcttctgagtaataggaggaaaatgtgtgcatgcttgaatgtaaataaatttaaatgggttgtgagccaatgataaaaaagcagagcacttcgctgaccttcaactcccttcccttcccagtctttccctttgaaaaggtcaatgagtagatcctaaatcagcaaatagcagaggttgagtttcaggccacatccagtttcttccttctctgttttcaactttacatcccatttctcagatagcacctgctttatccttgttcctatatagctcagctagtgcgtgcaatggtggcaaagtttctctaaagttgtttttgataaaggagctggtctcacggtaactaccatgcaccatcggaatgctacaaatgcttcagaatgtcacattgtcaaaatatctatatttcaggctcataagctagacagctcgtttggctgctaaacccacaagatgttcagccatttgttgtggtctaaaaactttccccctcacaaggagaaaataatcttctattgttttgtatcattttgtggtcttttgagttttttataatatgagagggcaaaagttatgagatcctgataggtaaatcgtggcctggattgaattttgctatcagtctctcttgaaatcaaattaatttttcaatatgtagtgaaatatctttagtctgtccacagtatgggaagatcaagggtatgaaagagtagggtgacttgccttctttgaggtgaagggggtggaagtgatagtttgaatgcatattgcttacaattgcaacaggctggcttttcctcagaagaaaaatgccgtatgtgtttttatggcggcttcacttgtttttattgcatgggcgtgtggagctgagatctacttctttgggaaggatggatcacaaaaggcaagcacaagaaggttgcagagggacacttgacatcaattgaaataagggccagggcagttgcatcctgagtggatggcaatggtccagtagaaccgtcatctggcaaagttagctgtgtttccaactgtaataattagtgagcctggaggggcttgtggcaggaaaatagcagatagaaacaaagaaagagaagcctggttaagttcctgctgtaaacatgctgggattagtaaactcttggagttcctgtgccataaacccattggaaataagcctttataccagcaggttaatcgtgttattgagtcaacaaatctttttattctggggtcatgctgtctctatcactaagtttctcctgtttttattgacaaagttgacatccttatattaatactcatattgtttcagtgggaaagaatttgagctccaccctcttaaaagctaagaagtttgatttgttaatttggcatgctcattttacatgccatagtgcactgttaaactagctcagcttctgtttgcctggaggcaaaacttttagaaggagactggagacagatatgaaggagaattaatcagtgctactgagtacttcctaaattcttagggcttttgtgggtgattaaatccataaatgatgtttggcatctgtactgagttcttttggaagggcaggagggagaaatgccatggaaattaagctccatagactcttttagcattgttgtaaatgatgacacagattggtggtggtacttacggttctggaggcagatgacactagcacttggcagaccagacaccaggtggaggaagatggagagtctacatggttgggcttagaggcgtcttccaaagttgaacttgaaaatgtctcggagatttctattaccacatggtctattttgccacttatggatctaataaagattcatgcaaattaaacacagtattatgtatactagaaccttcactgatccactgggtttccatgggcaagttcagtgaaagctcactgtcttcttcttgcagaacttatctcatagggttattgtaaaaataaaaaagaatagtttgggtgcaatgctaagtagagaacctggtgcaaagtagattcactgtcatttattgagcaaattatttactcatctttctccttctatgggccaatgaagtatttgaggtcaaggaactgtgttttctttatttttgtaacatttatcacagcgtctactgtttggttggtgcttaacaaatgtaggattacttaatgttagatattatacatcatattatttatatattattatatataatatatacatatactatatgtcttatagatataatatatacatatacaatgtactgcatgttgtatgctatataagttatataatgaatactacatctccatatgtgtcatatatttgctataatacttaaagttaagcaactaattaattattttatattaggattcttagaaaagaatagctgggcttggtggctcacgcctgtaatcccagcactttgggaggccgaggtgggtagattgcttgaggtcaggagtttcagaccagcctgggcaacatggtgaaaccctgccgctactaaaaatacaaaaattagccgcgcgtggtggcacatgcctataatcccagctacttgggaggctgaggcaagagaattgcttgaacctgggaggcagaggttgcagtgagccgagatctcaccactgcactctggcctgggcaacagagcaatactctgtctggaaaaaaaaaaaaaaaaaaaagaaagaagagagaagaatctaactatttgtattgtctagtatttcaccagttaaagttagccagttctctgggccagttgctgagtaactaatcagttcttttagaaaagatttgctaaaattagctggggaaagaaaatcaggatttgggtagataggtattgttgaaactaattccccccacccataaagacaaatattaggttggtgcaaaagtaatcatggtttttgccattgaaagtagtggcattacttttgcatgaacctatatataaaaattcttcaagggtcatttgtattgtacacagatgtttcctccttaaagtaagctgctaacagctgacacagttgtggatggagctgtatgcagaaatccttcgcatttcttttccttgtttcatgtaccatgtaaaatcagttttaagtttaaaactaagttgctcaataatgagatgcccatttcccccaacttctgttctgttattatatattgctctatggtttaaagtgtattccatgttgtgtctcatttttgatgtttatttattatgttcatttgaaagttattgtacttgtatgttaattttcattgatttttcttttgagcatgacttatgttttattttgtgtttcttttaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtatgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccactgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgtttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcatctccatgtgtcttgcattctctgtagatcttgtgtacttcctcacacttcctcaagtgtgtgctgtcacctgagtgcccttggttgtgttcagaactgaagactttagaagaaacagtgtgagaaatgtcacggagagtttcaggggagtaccaggcccatttcagattctgtgataaattatccccccaaaaaggtcttttaaaattcctgtcagtatgaattgtccattcattgtttactgattcttgcatcagaaatattttatttggctaaaaggcaatccttaaaaaaaaaaaaaaaacttatgcgaattttttttaaaaaccctaaattctatggcaaagccctttggtattttaaaaatttgaaatgacccaggtcacaataagagagtatactcaatgctctgtttctctattctaaatgactttgtggacatataaacataatgacttgtacttgaaagcgagagagaggggaatatgttggatgtagagggaagataccatgagaccataactgttagcatggtgcccacacttcatgtcccttttgtctctatcctcaggtcagctgcatggttcctgccccatttttcccattgaaaacaggatgtaaaagtgaggtttgtaggacctcaggctccaattcatttgagcctgccattcccttctgttgacacccaaagggttttgctctaaatcagacttagggattggaaaaactaatctagtgtgacctcatgctttatcaagtcaagtatactgcccctcttataaaagcccagtgttgggctgggcgtggcggctcacacctataatcccagtactttgggaggctgaggcgggcggatcatgaggtcgagagttcaagaccagcctggccaatgtggtgaaaccctgtctctactaaaaatacaaaaattagctgggcgtggtggcgggcgcctgtaatctcacctattcaggaggctgaggcaggagaatcatttgaacccaggaggtggagtttgcagtgagccaaggttgcgccattgcactccagcctggatgacacagcaagactccatctcaaaaaaaaaaaaaaaaaaaagaaaagaaaaaagcccaaacttcagtgttagtgacttgtgctttttccaaactcccttctccatttgttgaacgaagaacaggttgcatctaacatctgaaggtcatatgataatttggagtggcaggcatttgtcacagactatgcaggtttgaatcccagctatgctcacgaacaatataatcttgggaaagttctttcactgctccgtgcttcaatttcttcctttgcagaatgagatgatggtaataagaatagtacaatatttacctcactgggctcttataagagttaaatgagatggctcaggtaaagcccttggcacattgcctggcaagtgggacactcggtattgctaataactaatacttcaaaggagctttggttggcgagtcgttgggtgtacctcggtaaatgtccacgaattacaaacccactcgcatatcttggtcatatgcagattgtgtggttgcaaataatggaaaccaaatgaaaggaaacttcactcactgggtcatcctgggtgtggcccaacctgtgaaggccactttggaattgtttcaggagttattaggattctgctcttgaattcttctctttatccaagccaattcttacacactgattctgcctcaggtttgattttgataaaataagaggatctgatttatttggccaatattctaatagttccatgagtttgaatgatggtctgttatttgcaaattcttggagaaatagctctgaatgtcttacactgaatacagctggcctcactagttctcattttgttaattcagatttctttttatcatttcaacagggaatgcattaactttactttttgaattatctatttaaaaatctttggctaagaatgtaagtaacaacttagccaaaagattgtttcaaagaaaagacagtttcaagttccctcaagacttagaaacgagtattcacaggcaatgagttatgaataactagattattcttttccttcctgaagttgtttctggtaatagctctagaaggccacacatgattggcctagttggaactacttcatgtttgaagtcataaatttcatgttattaaaaatacttcataatttgcacttttttcctatcattaaatcattttaaatgagtggcgttgatgtatttctagcacttaatttaggacaattttactattgctaccacctttcctaatacatcctttagtgagctctaccacaggacctaagagataatgataggtaacaggtattgacttcaaacttaagtgtttcatgatcctcccaacaaccttatgaggccaaagctaatattgcctgtattgtaacgattaggaaactgaggaatggagccatgagggacgtgcctcaggttaccgagctaacaagttaacactaggatttgagttcaagcaggctggctgtaaagctggtgctccgtatgtgaactggattcttgaactgggctggggctagagcgaggccagccaggtgtctagggcacaatttgaaagacggtggtaactcttaggttcatgcaagtgcccagtggccactcctactagcactggcagttgtgttattgttgcactaaagtagaattctaaagttaactgaagtcactggagaggcaccccttgatcccagcaagtcttcaggtatttgtgccatgaacaaatccttttcagatcttgacttgcaagtatgtggcacagtagtgaaattggcacatacattttaaatttcaccttgtgaaaaagagaagttgcatcaagtctgtaattcagcgctaattagttaaccccagagcacgtttgctttgtccgttataactgaagatggatttgctgttttttattgccttcaggtgaattttctcatcactcttgaactttagtacttcccattcttttggagtagtccctactctctggtgagtgaacttgagggaaaccttgcgagtggaaagggcctggtgggaaggggtgtggaggacacgtcctgccatctccatgaacagaatccagacatcagaacaaggtggtgaaaaatgcctgcgctgttccttgcctttcgaacacccacaggcagagcagcgtcggagctgcttggtcacttcaatgtgcctgtcctcgaatgtcccgtctggcagccagtgattgagagagactgctgagggcacatgctaattttccagtcatttggtcaagccccatctcacacgctacaagaccctggagcctgtgtttactgagttaaaatctctgcctgaccataaattaatgaacagtaagttccctccctctctcttttagaaatgtttatcctgttgccaagaaggaaaggagaaacctcttttgtgtttattaaccacgcttccatctctttttaaaaattatcatcatgctgtaatcagtcttgctgaattattatatagaaacataggccacggctgtttgctttaaggattttaattcagcctcaagtaaattcatgcaatttcacctcaagccccttgagtcggggtaggaagtacagagtcgccagcactgttttaccttacctgtggagagttctaggtttgtcacctgaactaggacacagcctctgagggtgcttccaggcttttcaaagactgctctcaaggcagattttcctctttgcgtttactccaggctcctgggtcttggggaggttgattgattacctctccatcacgcttcactcaacgctgttgaattgaatgccacgtctaattacatgcaggtctcctgctggcttctcagggtgtctgacccatggggtgcactggcaggtctcaggcagaggaggcgttcagggtatgtctgttgtgttccccctgtggaggcgccagccttaaacaggctcagccctccctatctggagtcctgcagaatggcgccttctctgtggctccagctctgtctgggatccagcaaagctattttcccttcctgatccctggagttggtaagggcttcccactgttgtcagttcctgagtgcctatttcctgtttgtttctttaccccgcccgcatctctctgtgtggccctacaatatatctcttcatttgaaccatatggggtgagttatttttccttgacaaaaccctgagacatatgttatattctttaatgtatgatctcattttatcttccatcaaatctcttccaactccagtaaatatttattaagtgtcaattatagttgaccctttaacaatgtgggggttaagggcaccaatcccctgcacatttgaaaatatgagtataatttttgactgccccaaaacttaactactaatagcttactttttttctttctttctttctttttttttttttttttggtgacagcgtcttgctctgttgcccaggctggagtgcagtggtgcgatctctgctcattgcaacctccgcatcccaggttcaagtgattctcctgcctcagcctccctagtagctgggactacaggcgtgcaccaccacgcccagctaatttttgtatttgtaagagagatcgggtttcaccatgttggccaggctgatcttgaactcccgacctcgagtgatttgcctgcctcggcctcccaaagtgttggaattacaggtgtgagccaccgtgcccagccaatagcttacttttgaccagaagtcttactaattccgtgaacagttggttaatacatagactagtatctacatgtattttacgcattcatgacatatttaacttttcgttaattttttcaatatttctatgttacaaggttcatctgttaattttttcaaattgtttcaaatctcctaaaaatttcgaatatattcattgaaaaaaatttgtgtataagcggacctaagcagttccaacctgcgttgttcaaggatcaagtgtgtatgtcggccagtgagctaggtgctgggaggtacctccacaaaccaagcaactccatctttggccttatgggctatggcctaatggtagtgtgtataatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctctaggctgcaagttctgagctagccataagatctctgctcttcattttggtggctgtaattcttcttgacttggtgtaaatgcatgaagtatccctgcccttgtaacctgttttcttttttttatttctcttttatctttttttaaaaaaatcattttcttctcttttctttcagttctctttttactcaagacaaacaccataaatatgctttgtcttttctttaattttcacactttaaaattttcaaattggttgggcggaatgtacttagcttgcatgtttatgtgtgtgtgcgagagagagagagcaaggaaagggcacaagaatttacacacacaaacacacacacacacacctatggaataggaataccatgtattttcagttctatttgatcaaatgggaatgtaatcccagtacatacaccatttaccattatcacctcctcagtgcttactgtgctgtaacactcccagctcttcttaaaaaactttccatgttgtattttttgctctttgtttttacttccttataaatagcaagaagttttgctgagaagaaataattacaaatcccaaaaggttggtgttccgttctgagctccaagatgtaaggattgagtggatttcaaacttggcaaaatttctgacttggcaaatgcttccatccttatttatgacagcttggaaacttccattttccagggtttataaatgatgctgctgattttgtctcctttttttattttgctgtgaattataaaataaccagcctgaaggtttccttataatattaaccctcttagcagagagggagagaagtagagagagagagagagagagagagagagaagagagaatgtgtgtaaattgctgtgttctttcttttcttggttatgaggtgcattttacatatttcataagcccatttacttccctttttctgcctttcaacaaaatgaaaatctagaaatgttgaggtttgggatacagagagtgacaacctgtgtttgtcattttcaccataaaggacttcttggccagcagtcctctaagggatgatacatttcatctccaaattgcaatttagcatttggaattctggagcaagataggtaatgcataaagtatcagagagtctttttctagtggtgtgaataggctatttcagggggtctccatgcccatattcttagaaaattgtccaagtggaggaaaaacaaagaagttgtcaccttcttttcccttgacactcctcccccactgaagccttcttctttttctttttcactttcttacttctatactcaattcctcaaagcccactcatcttaggtttcctttgtaagtgctttttcctttcgattcatgggaatatgaagaaattaggagccttcatttattgggtagagtagatagattttaccaaatgtgggcaataggaattttgcagtgcagaatgtgtcctctcagaagcagacaccaagatggaattaaagctgcaaagatttttatcctgagaaactcttgggtgagagaaactgggaagggaatccgagagcaaggatctgtaagagcatcagactgcaatgcaagcaggactgtgggtgaataagagagggatggaggcttaggtcaagcaccctcgactgccgttcactctagggagttactggcgaggctgctggggagtatttgagccaaatcagccatcagaagacttccttgtctcccaggagggttctgcctttatatttccaccactctcactcattggctctggagcttggcctctgtgcaaatgaggcgataaattcctgagttcagcatttggtacccttggtcaactatgttccctgtccttgaaggtctacgaggtgcattctcaacagtagacactgtcttatctgagctccacttaacagatatgctcattaattgctgcttgccatctctctgtaaaacacaatgaccaacctacaccctggacactcctggctgaacatctgggttgagtgctttcggaaactccacttccttaaatgacctactgtcagtttcattggttaaaagggcttctactacaatcattttttttttttaaaagtacccaggctgggcaagtcaacattttgaaatgtttaaaaaatgtaatttttgagctgtagctacccttttatttatggcaacataaaacaacatctgaaactaagacctgtttttgtttttctcgcctacatactaaaaccacgagtgatttttatttcatttcattttgtgttccccatcaaacaaatttcctatcatgacagctcttgttattgattcatattctttcagaagagtgtttatggaagtgtacatcaatgccttgccaggcatgaggaccaagtcggagtggtacagagcgatgcatcctcttacacaattactcactcctggacttcagcagcccttgcattgaattgttttcaaggaaaatgagaccttattcagatgcaaccaactttattgagtactttctatgtggtagaccataggttcctgattcaaatgactacaggttgggacagtcctgggcgtcagtagctggggtggaggagaatgccccatgcacaggatagggctgcccctagcccagcccatgttggcgtgcaggaatgaaagcctagcgtacccaaatcttctgatttttttaagacaaggggagatccgggtttttatgtgaaattttctagtttttaaatgttggcaagacccttcacattttttaaggtctctatgagccaaacataacaagtgttgatgccaaatgttgccgtttgtgactttctggctggacattctgctcgtggctttcagacgtggttcctttacaacagccctgagtagatacttgtcttaagtcaggcttcctggaaacagatgctgagatgaggattcatgtgcaagtaatttattaagggtgtgcctgggaccggtatggggaagcaggacagtgggggaggagctaagcaggagtatgatttgagccaaagccttgtggaggtggtttcagccatttagtttcagtggtttaagttgcccttcagagttgtcccaccctgagcttagggagctgggctttcatatgtgtacacctgtcagtcattagctgcaggttgcaacaggcaaaaatgggctccaatagctcaagggaaggcctccagaaaagtgacacaggtgctggctgttggcactgcagggcacacaatggcagtaacagtggttctgagagaaccctcacgacccaccaccagcaatctgtggctctccctagtcgacaggctgagccagaattcagaaactgatcttttgactctgtggccagtgcttgttggcaccctttccacctgcttcttactgagatcagcatgcagaattcagatcatcttagaccctggcaaattggtatgttggccctgggctactagctcttcttttcctctagtaatgcatggagagagggtggcatggctattcagaggtggggcagcccaacaggagcaagaaaggggctctggagcccccaaccctgtaggcagccctaaatgggctcccaagagaggctgaggcagctctcagttctaaatttttcttgctaagtttggcaatttcttccctgagatgcagacagtgtttctgggtgctctgtgtcctggtgagttctgggcctatgagacacacttgtccgctgctggaaaggtggaccttttggggaaataggccagcagcttctacatcttgcatcacagtgccacagtatgtaggctgtttcctttggagagcttaaagctattcatggttttaatttggagatacaccctctaaaatccaaccaatttcccttgaaggaaatctatcagatctgaggagagaagacagaagctacagcaccatctgctaaccaaacacctctggattttgtgggttccagaggcaaaaagatcagtttttttttttttttaactgagttcatcacgtgttcccagacacacctgccccgtgccttctgctgtagtggacaatttgctcatccttccaactcctggattacccaggacagctttcctctccctgggctcttgaatgtggttccaaaatcaagccaagtcttcctcacccaaatctttcaaacctgtccattttgtgtacccccaccctgtctaccatcctccaggccctttgtaattgagagggccaagctggtcttctctctccccttctcaccatgcttccaccccctgagccccacattatcttcccaagatgcaggcttgagccttaggcaacttgcgcagctgagtagattaagtccaagcttctcaaaagagcatcccaagttcaggacattgtcactccagccatgcttccccacccaccacctctggtccacttccttaagctgcctactccacttggtttgaccctcttcctcccaccaccctcaacttattgattgggtgaccttgaacttggcacttaactctccaagtcttagatttgtcctcattaaaacaagggtggggtgactaggagatttaagtggaaaaaaagtctggcaagtcattcagacagcatggcatgcagtaacagaagcaatgaccataacaatgattatcatgattgttacctatcttcccaccctcctagaagctggcacagaattctgcacacagagtggcaccttctttcctatacccccatattaataattgtgccatagtgttcatctggtgagaggagcttgggtctgctgttgctgcattaaactggattgctccaaagcattagaccacatgccactcctgtcaaaggtgctactgggctttcaaagaaacagatgaaaaagatgtgattctcagttgagttcacttttgttgagatgtgtgaatgtttctgagtaaagctatgtgggacctcatagctgaaaggctgaatcagaaatagggagcttctgaggcacggaagatcagtaaagctttaggattctgaatgaaactaaattccaccccccacccgccatggacagcagaagcaaagatctctggggaacttcttcaggatgtgaaccaggggctgccataacaagttaccacaaacgtgatggtttacaacaacagaaatttattctcatcattgtggagtctggaagtttgaaagtgaggtgttgacagggttggttccttttggaggacctgagggtctctcttagtttccaggggcaattatcggcatcctttggcttgtagctgtatcactccagtcactgcagctgccttcagctcgccttctccctgagtctctgtgtcctctcttcctcttatagaaattctcattagatttaaagcctaccctaaatccacgataatctcatcttagtaatttttaataacatttgcaaaggcccttatttccaagtaagatcactgtcacaggtttcagggctcaggattggacatatctttttttacaggccaccatgtaacccactacctggagaacagagttgaactgagaggttgatagcacaatggaaggtacaggatgtagatgccaagaagatctgagttccaatccctgtttggcccatgatgtggacgtatcccctaacctcactaaatctcagtttttccttttctgtaaaagggggatactcatttccaccacgtagattgtgagaataagttaacaatgcatgtatctagtacttagtagattcacaatatagttattgtctatagctattaccaccactcattcattcatttaataaaaatttaaatctctggacatcaaggtgaaagagacatatcatatggcttttagtcataaaaacactttgaaggagttttgtgtttgttgaatgaataaacaggtgttcagatctgaagcctatcagaagtatttgctttgttccaagcgaaagaagggggtttggcaggtcctcttatgcactgtgctgcctgcagggtgaatgatgatgatggtgatgccagactttaaaggaagctcctattttagactagtgtttataatccttaaagaatatcattacattatcattcacttcaatggtccacataggtggtcatcagagtgaattctatggggaactaatatcaagaggcaatgtgaggtgtcttaactaaagaaaaaaacttacagcacagagcaaggtggggccaggcaagtaacagttaaagggaggagagaggggcagccccttggagagtgtgtgtcttatttaaacagggcagctgatactcactcgttcattcaaccatgcatttaacccttctccttgccttggactgtgccaagtgctggggccacagggtgagaaaggcaaagtactgtcttcagggagcttatgttctctgagcgcaactccagctctgggtgccacgtgggaatctagggctttttgctgccaaatcatctgctttttaaagagaagaagccagaggttatgtgaaatctcctgatttttaaatgttggcaaacaatgtacatttttaaagaacactgtgcaggccagacaaaacttgtcttttgactcaattgggcctggcctgtaggctgccaatctgtaacccttggggtggaatctcatgacttttgccttaagaaacatttttcaaatgtctgattttacgctaattctcatttttcctgacttcattgcaagctgccaatgcttactgcttgttgtctatgtcctcctggatttaacgattcctaggtgcttcacctctgcgttttcagctgagctaacctcagtctatcagtttctcccttgcaaacctaagccccatatctttgattacagtttcgtgttctctcaagcttccagaaaggctctgagcattgcccatttttccctcaacatttcttctcttgagaattggaatctagtccaaacccttaactaaacagcttatagattagagctgcttttaagcctttcttttgaaacttgcccttccaattttcatacccattgagttgcattgactcccaaccttaggtgtgatattaatttctctcagagggacatggatttaatagactttttaattaacattttgcagaatcggagctgtcattctttatggcagactgatacaaatgtctataattacatttttggcattacatctggggaaaagtctagagatgtttgttttaaccccttcctaaaacatactgatttatgggcaggcctctttgtgcacacctctaacaggcccagttgccatgacaacgcagaacatcatttgtcaaagagctataacttcattatatgttgaagctgaaaatttatcttttagaatttatttttatgacagggaaattttgcatttccatagatatgcttcttctccctaattctgcttgtctttagggagattcaggattcaggtgaatactttctagagaacaagacaaacctcctacctttcattctctccccctacccccagatgaattattgtattcattccaaagagaactcagatggcctcattagtacaacaacacaacaaaggtgaaattgtatgccaagtgtgtctaactaaatatgatttttgtttcttttaaaagattaaaattttattggttgattatttttggcagtaaagttcaaagaaagggaagaaagaaaatgtctgtaaatccttcctacaagctggagaaagtgaaatatttagttattatatttccttgtgtgatgtgtgattcatggattgaaaagtcaaagccgattaaaggggcaggcaaatatataaattagtgcagtaggctcctggggactgtgtcaaatggaatgctacatgccttctctgaagatagtagcttgttagtgtttactgacaaatgtggacccttgtacaggattgtttgttttgttttttttttaaagaagccagaaatctatggtgttttttttttgttgtttgtttgtttgttttgagatggggtcttactcttgtcacccaggctggagtgcagtggcacgatctcagttcactgcaacatctgcctcccaggtttaagcaattctcatgcctcagcctctccagtagctgggattacaggcgggtgccaccacacctggctaatttttgcatttttagtagagatggggtttcgccatattgtccaggctggtcttgaactcctgacctcaagtgatccgcctgccttggcctcccaaaatgctgggattacaggtgcaagccacagcgcctggcccagagatcaattttcacatgaaattttctaattttaaaatgtcttcaggtcatatgaattttgtttgtttgtttgtttgttttttgttcttttttaagcaggtaatagtcaaacaaagcacatctgagggcaggttcactctatggactcctagatttggtttctgccctaatgaatgctacacaacagcttagaatggctttgtttctctaaacgaaatagccaaatcaatcattgtgctctccaggccttctcaggatctggtgtgttgagtgttctgtctgttggcctcttaaggggcgatgttccgcctgtttgcatgctgggccgttgttggactctgcaccacccgggagaggacacagtgagagaatcccacctgctcctcgccgacatgccaagatggatggcgggggtccatcagatgccttctgggattgttcagggatttatgatgctcactttttgttcttgatggatggggtcatttaatcctctgcactaaaccccatctttttcttttgtattgagaactcctggactgctgctgcctttccacaagggatagcaaagattttctttcctcttactgcatttgagagtgttttgttactcattcatcaatgagggaaaaacactagtaattcttgggaataaaccatcaaaaacatctggggcaaagcttccctgtgggtattactgcaccagagtaggagcagtttagggaacacccccttctctccaaatcatcctatggtggacatctatcacctatcatctcgctggttgaaagttagatttaagacatgttggcattcatgtagacttatgctaagtatggaagcctcacagtggctctggcaacgacagcaggtcaagacatgcttcatgcttcttcccacctttcccaggccctcccatgatgcctttcacacaccctaggcacaagtctgtccttgtttaccctcacgttcttgtatacagtttcctgtacacagaatgttgtgcaccatcgtatctcattttaacccaggcagggctttattgatcctttatgggcatttaaatattagcaccactggttagaagtgtgatagaaacagtttcccaataagtagctgttagaaactggcacaggtttgggttccttattattttcctgtctccttatgctttagagcagcctaagggtgtgtgtgtatgtgtgtgagcatgcgtgtatgtgtatgagcatgcatgcgtgtgtgtgtgtgtgtgtgtgtgtgattttggcttaatttttctttctttgaactgttcttagcctataagagagaaaggagatgttatagattattgaacaaaatatgctcataccctatgccaggtagaggcagtttaatctccaaagcttttctcaatatttttttaaaaaagtattttgaaataaccatagaatggtaatgaactaattatgatcccatattctgtgtttacttcttccctcaagtgatttttaaaaatcctactggcattgtattttttaaacaatatatgaattacaaagtagtaaagatttcctataatcctgccacccagaaatatttcatttagttttcctaatgcttttctgtgcctataattgttctgtgcttgaatcatattgtatataaatatttttatttcctattacatgtactgaacagtatatttacaaggatttcttcatggagttaacatttgtcataaataaacttttccatcgctctgtaatattctatcctttgaataaaccataatgtgtttgatattttcctagtattggatgtttaagtaatttccaatttcattgttaaaagtaacactgtaatgggcatctctgtccatatctctggattttttcctaggattgatttccagatataacatttctaaattatgaggttttgatattaagacccttataatatattgccaatttactttccagaaatattggcacagtcacaccagaagagtatacaaatgcccatttgttagcaaccttgttaacattgttttgctaatttctcccctcatctttgctttagtgtttatatgctgttttatatacaagtctaaccgaagggagggggtcagggaaagggagagagagagaggatcactgcctaataagaaaaaattctagttttctatgcccgtggtacattggtggtcagttacccaggagaggcactttagcatataccagacagtactttaagtgttttccatatgccaactcctgtaatcctcacaacattcctgtgaggtagataccaccattatccccatccagagaaagaaagtgaggcccaaggaggctaaatgacttactcgaggtgacggagctaataaatgtcacagcaagaattcagacagggcctttgggatccagagtctgcattcttgtaagagaaaagaagagacttcagggcctaggccacatgatggataatcaacagaaggggtggtcagcacaggtgatcacaggatgtaagtacacttaggagattctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattgcatttgttttatgcctaaaaaacatagttgttttctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaaaggtttacgtcctcacagggaattttaagttcacaagaaaaatataacaaggtagagcaagataaagatattaaagaaccaagtgctacagtgatcagagaagctatttcttgctgcagagatccagggaaggattcctgggaagctgacatttctgctggtcctgaaaggagcagtaagaggataaaagcagagacggaggtgaggagcaacctggtggaagtgtcagggcgagggaggtgtagaagcagcacaggcccagctgtaatcacatgatgcagcatcgttgttgcgtgtgataaacatgcattaatgtctatggctccagctgtgtattacgcaatctttaacctagatagaaaaccccaaaccccttgaaccagctgcgaaaacataaagaggacctgccttctccttcatttcactgtcttcattcacctcagtatgatttgctgtagtctttttcaataaaagtctgttttacggaagtgctcctgagctggcccagtgtgtttgaatcgcagggaggaggacgatgcgggagaaattggcttgaatccttggttttcttatttgggccatagataatatcggcagccacccccgcacctggatagattggatgcgggcactcctgcacactctatggagccttgagaaggccgtgctgggctgagtggggacttctgtgtcagaggagcccacagctgaggctgcccttcttcaagtgtggcctgtctcagaatcatccagttaaaggtgcatattcttgggcctcattggtggtggtggtggtggtggtggtgggtgggtagggagggcaagagactgcatgttcaaaaagctccctacagggttctgatgcacactaaggtctgacagccattgttctgtgaagtgcttctcagcttgggctgcacactaaaaatcacctggagagatttttaaaatatccatgcctgggatccacactagaggaactaagtaagaatatctgggcatggggtcttgacagcagtctctttttaaaataccttaggtgattctaaggtgcagacaggtttgagaataacttgaattggatgagagtaacctaatgcttttagtgatttgcatgagaaaaagaaaggaaagaaaaaaaggaaggaaggaaggaaaaaaggaaggaacaggaaagaaagaaagagggaaggaaggaaggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagggaaggaaggaaggaagggatcactctagtagatactaagaaaggaaagaaaaaagaaggaagaataaaagaggagagacagaaggaaagaaagagaaaaagaaagaaaagaaagagagagagaaagaaaggcaggaaggaaggagggaggcaggggagggagggggcagggatcactcctatagatactaagatgagtgtccaatccattcttactcttgtattttaggactacatataaatctttggagcttcatagcagcttcccttgataacccaaatcaagtaactcactgacactttatttcttacctggagcactttttaaaaacccaggctatatcccagacctaagtaaggatttctgggggcaggaccatcaatgttgttaaagttccctgggtgattccactgtgcagcaagggtgagaattgcaggaggatgcccgggtgaggatgggcacagaggtgtctccatgtcttagttcatttgactttcatcttccacttgggtagctcactacaatcgccatagccactgtgtctgtggtgttatactgtcacctgcctaaaattctagcttagctggagaggtgggcattttcatacagaactttacaaaatacaaacggagaacctatcaaaagcctatcaataaggttgccagatttagcaaataaatacaggattcccagctaaatttgaattttagataaacaagaaatgatttttagtataattatgtttcatgcacaaaataaaaaattatttcttctttgatgaaatttaaatttagctgggaattctctatttaatcctacctataaaggaagttaaatcaaatcaatttaaaatagcaggtgtctgattctacagttaataacaggtctccaggattgctgtgccctggaggctgcccccaggataattaggcctgagccccaaagtgttagtccccctttcttaagtcactgttaacaaggagggagttgaccactaattacattttttcccttgatgatctaggtcaacacttagtctggagcatctaggaacccctagaagcattgttctagtcactttccatttcaaatcggaggggtgtgtctcatgttgagccagtataacaattgacttcatctttcctggctcgggttactacctctgcgcacatgttgagagttctagttcaagcccactgactgcaggcaacaggaaaggcatctgtaacattacgcacaaaccattactcatacacagggccaccttcatgggactgagatctgtgctgtcatatagcttagcagggctgcctgcttggtttaatgctctgttgtcaagattttgaaattcttaatattttataaatgaggggtctgcattttatttagcaatggacactgaaaattatgtagctggtccagctcatgcaacaaaacatgggcaatatagactaaaagcagtggcatttttgcacagctgataatttacattcctggtagtgggtatggccttagtcttctctcttgggtaggtgatattcctttggcggggaaaaccataacaactgcctacccatgccttctagctatttcagggatgcctgccttaacaaagacttctgccatccaaatccagacgttttatctgggagcttgaattcacctacatatcatttcaagtgtggctatctttcagagtggcatttagtaggtgtcgccattcatcaatcagcaattattgagtatctggccctgtgcaagacatctttcctcgcttgccccttcatcattatcaatcatcacagtagatgtatccagtgcccatctgtgcatgaccctttgtttcaagatggtgtgtgctaagctgtattctgtcagcgaaatgagcccccactccaaaaggcagtcagggttgtctttggaacagagagtttctcctcagctaaaaaaggatgtgtctatcaagtgctaaagccacgggatatgttttctggccactactagatttagacagagataacaacaacaagaacaacaagaacaacaacaacaacaacaaaaatgcacaaaactccaaagatggcccattgggttggcagaaaaccaaagctgcccctccccccttctttgtaatggtcaggttgtaaaatcaggcagttgtctctcaaaatcattgctgaagatagccgcatgggtaacagcagcgtgaggctgacccagggaagccagctgatggaaaactattctgaaatcctgtgtgtgaaagtaacctgaaaaataaaatgtgtgagagcaacgtaaggcatttcttttcttatttatggctcatagagcttgcttgaggcatttcggcatttcccctgcaatgccagcaaatcctaatctaatataaaactcaaaacaattgacaagacagaacagctccagaaacataaggaggccctcgtggttgaagagtaagacaggatttactggcatggctcgtgtattgtgccaaggcataatgctagatcccatcacattgtggggccgtcttagaacagaaatctcagggaaacagagcttcttaccattctagcaaacaccatagttctgttctttgccaaaatgtttttaagttagccttatggcagaagtaaaattgttaaaatatgctgacatattgtgaacattttattaatcaaagagttactattcaggtatttaaggccgtgcatgttgatatggggcaaaaaaatcactgctaggtttagagaaatgcaagaagagggcagctcttcctatgatctgccctgttcttttgccctagttggttgggaaatgatggctatgttggtgcttttaagtaagagaagtagccctgcaaggaactgaaacatcttgaatgagggaggatgctcctgagttgaattaaatggagtggaatgatgggcaagaacccaccaggtacttggagcatgtgagttgcagtagggaaagtgggatgagcaagtacagtcaatgcccttgggggacttgcatcctcattgagagaataaattattatcctattagattacactctaatgtaatgttattgttttctagcataatctaatattatcatctagtatgcaggaccacagtttcttgtccaaaactcatggaacaggatgccttggatttgggggatttggaaattttggaaatgctcactatggttcatacagtgattatcactaccacctccgctggggccttggggagctctccacagtcaatgatatttctgcggtggcactgaggctggtcccagtaactgggatcagtaaagtctacaaagaaccttacaacaattcaagtcagattttcctgccaagcgagtgtaactttgggttttcagaacatcttggatttcaaaagtgcagataatagattgagagcttgtcgtagagtataatataatataatataatataatataatataatataataatactggaatatactataacagaaattcaatgagggcattatttcccaaatacccagaacaattcctggcacagagtaggcattcagtaaatatttgttaactaaataacaaaagtaataagaagaaatgttacttgttattttattgagtgtctataccatgtcaggcatagagaagcttcatactaatcctttcaggtaggtgttgttattcctattgttattcttattttagagatgaggaaactgtttctgagagaagttaagtgaccaaagctaccagggtggcagttgataaagctgtgattgaaactagggggtttggctatggggatcaagagcccacttggaaatgtcaggctgcctgggatctaagtcctaattctgccgctcactggccaggtaaacttacactaatggtctgactttgctgtgcctcaatatcttcacatgtaaaatgagaataataagttctatgttatagaattatttacagatatatataaagtgcttacaaactgtgtttggaacttagatagaccctcaatgaatgttagcttaaactgatgctttcgagggaggctttgtagcaaagaattttgtctgattgaatagagaataaaaagataaaactttagataacctcatatataacccactaatcaaagaataatcacatgctactatgataaactcaggatccagtaactaagtctaagtcacaaaagaaagtctatttggttgtctcaagtgatttaggtgttgctaaaactaaataacttttcttttaaaaattggtagactaagaatagaagaatgcttcctttatatgctaaagatgccatgtcatataccaacagtcaccatcatacttactgataaaatctaagaaattttcccattaatatctgaagcaacacaagaatgcctatattattaccattattttatcacatcctggaagttctggctaatggcataagacatgaaatggttataaaaggtttgcttatggaaaaggcaaatatattaataattatagatattatgctttcttcaaaaatagtggagaatcaaattacaaatccaataataaaactagaggtcctataatctggctggataccatatacaatatttagtggctttcccatatgttagcaataatgttagacaatataatggcaaacgtgtcactcagaataggaaaacaacaacagcagcaggaacagctatagtacatccagaagaaaatagcgacagagatggggaggaagttatgtggacaagattgttagtctccacagaacttacaatagcaaaaaaaaggaaaaagaaaatagtgtgcagtaataccagaataattaaccgaattcattgagtgatggtaaaattgcagagataataaaataaagtacatgctcgccatacaatgttaagaaaaaatgtacaatattacactattttcagtgtatattgtatatgcattatgatcccaaacttattttttatgcagtaaaaatgatgagatcaagatgttattatcagacatggggttgtaggtgatttttattttcttctttatacttaccgcattttccaaattttctacaaaaagcaagcacacagtcatagaatacaacatgttactcaaaagtatttaagaaaaaataataccagaggaatcaatgtacctactattacttttcttccgatatagtatattgtaattcactattataatagttcactattttgtgaagttttattgccaatatataatttaaagcaaaataaatggtggcttatttaccaaaaatagataattctggactttaaaatataaaataacactacataccttctgcttcattgatttaaaaaattgaaattctgtacagaagccttaatgattttttttttttacaatgttttgctatgcaacttggattcaatttctggagtagagggaatgccaagatgtgcacaaaggccttgggaggtgaaataacatccatttcattaattctttgaaaaataaatgacctcactttctttatgactatagtaattaacactcacatttgcactgattcagaacgatgctttgtattatttattaccacccatttgtggtttggtggtcaacctaatgggtatctttgtcagaaagtttctgtttgtgaaacacattgaagttgttctcatctgcttgtccaataatttctcatcagaagagtcaaatacactttaaaaaacttgaaataatgcagaccacagatgagggcagattttaattctgacttttaattggcctgtcttgtatcctgttcactctggtaaaatgcaatattgattaatttccatgaatcccttagtcccttgcacaaagcttagtatgtaacagttgttcaggaaatgtatgtggactggatagaaatgagaataaaaaccagaggcttcaaactcttggacccgtcctcccatttcactgtgacgggtcttagtacattttgattctcatctaaagacattaatccttggggtcactcttactctgtaaagagcagtgaccatcttgctgcattaggtcaacaccagatatttatggagcgcgtacaggccatgtgctgaatcgggctgagcgttagtttttatgatgtggagctgatttcagagcctctagcagatgcagagcaatctgtgcattcttcaggccaggccccagcgtgcctgtgggttttctctgctttgctgcccgggagctatgctgccgccttctccctaatccctgcaaacaggcagcgtgtgaggagtctgccagcacatcaagtgtgtctgcaaaatgcagacaaattgctgctctttattagaggtacggatgaaggactctgggaagctctgaaactacagggctttgggtttcttggctacttttttctcaagctctactttcagaaatacgatgttagtaagtggtacatttcactgccaacatccctcccttcctcctttcattcctcgttctttccctttcttcctcctcctcctcctccctcctttcttaaaaatttagaaataaaataagaccttcttattgctttttcttgctgattaggaaaaatagccagccagttctaagtttggtcctttgtgagaaatgtgtcctctgcctggcgtcagtcatgctctcatgtgaacattcccttgaatttgtcctgtttccagctcatcctctgctaccttgatgcattccaggaccacaatcattgacaattctttttttttttttttttttttttaactctttctcactctgctcttgtcttcgctttgtctaactttgattctgtggtcgctggttataaggtcactgtttttttgagaaaatcaaagctgtctgaagaaaacacccacaagcctccccagaccatatgccacctttgtatgcatggccatggctctgccttctctcctgatacaaggcttctccccaggaccgccctccccatgtgcactggctggactctgacctcttttgcctgttgaaagacatcaccccagccattgtccactctctttcctgcagcgttacattttcttctgaaccggatcattcccatcagtttacaaatctggaagctcatattcctctattcctcatgtctgaaaaaacacactgctcttgacttcccatgcaccatgccccaatctagcgcgctgttctcctttgcctccaacaaccttctctcgaaagggttctttctttctccaattcctctctttctcctttctctttaattccctcaaatcaagctttcattccaaatgctgcaccagagtgtccccttcagaggtcgttgcattgctaagtcccatagcccctcccagttcttatcctacttggcctgttggaggcacccagcgcagcttcttgtttccttcttcactgacttcactttcttcactggctccaggctgctgcattctctcttttccttctacatgggtagtagaaggaaactaccaagtgggactgttgctgagccctgaagctcagtctttgagaccctctcctctccagctgctctccctcatatggggattttatccagtctcatgggtagaaacctcagatgcattttgaatccgtctccatgctggcattgcccacctctcgtttccaatggagacctgtcttccgaactgtaggctcgtatgccacctatctgctcagcagctccacttggatgccaggtgagcatcttacacttggcatgaccaacacagagcgctgagctgtcccatgagatgtgaccctcccacaatcaaacccaactcaataaatggacacccaggctgaaacctgtgagtccttgtgacccctctcttcacttacacccccagcctatattagctctgccttcaaagtatagctagactccaactgctttgcttcaccttcacagctactaacctggtgcagtcttctctaatctctcctagaatatctggccacattggccagagtgcaccctgggcaccgtactctctccctacagcatttgtatctgtggctccctctttctggaatgtttttctcctctccttcaggtctttgttcaaatatcactgtctcccggaggccttccctaaccattgttttcaattgcagcccttatacctgctagactgtcccggtccctcctcccaccttacttatggtcagagcacttgccactctcagatgtgctgcagatttccttgttgtcgttggtaattctctgtctgcccccacaaaatataagctacattcacggcagaaattttggtccatttcttcacttgtcctaaaacagttcattgtaataaatatttgttgaataaatgaatgaaagaatgaacatcccaggttgaatctagggcacagcaaggttcagagccatgtgatgagacgcatcccaagaaaagtgtcactgttagtggcccagatgtttccacatgtgcagatatgttcaatcccatagacaaaacattgaagcaaccagtggaactattcaccctttctccagaagtttgatgacacaagcagtgtgaatgactctggaatccctgctaatcccctgttttcatgtccagccagtcttgcataccattacatttcttctgctcaggaaaaggctgactgagctttgtctgggtataggacgtactttgggatgcaactccgttcctcgtgaagaggctctgacctctctatctgcacttccttctttactcttcaccctcctgatctaagtcttgccctcctgcaaatcatactccccatggctgccagcgttatcatcataaatctgtgttttcttatctgagggaaagaacgtttttaaggcactatgtgagaatctcattctggttctggatagctcaacagccagctctgaacccagaggaatgccgttggctgaagttactgatctgcttcaggattttacctccactgcaggctcacaggtatctgactgctccagggttgggactctggccgtggctctgcctctcctcgttttccacccatagtgctgcttccctggcctcactctgggttctccagcagaaaccggcatgctcatgggtgctcccatctccctggggctgatttcagtgatggttggggcttccctccgtatgaccattggaacctcacctcatccacagtctggcaccactacttggctacattaattattcaaaccctcagttttttaatgccacatttggagagaactagatctgagtgaacatttgggaaaactagacccactgttagagccaatgcaaaggccttagaagaccttagactgggggaacccagttttccagaagtttatgaatgaccaggagtgtctctaaggagaggaatgaggcagagtatgtacctagaggacctcataatctattcccatgatccagtctttttgaataattcttggcatctaagagcaagaactacatattcactttgcttcatttgctgtctgtgtggctgaatgaattccccagcacctcagttccctcctgtaggaatggggggtcatagcatctactggatggtattacggtgaggagctaataaaatgcctcatgcgtataaagaactcagtaggtgctaattcttcctactatatggcacacagtaggttttcaatctcaacattttaagttagtgggttggttccctgggtctacagtagatgagtagttattatgcctgcaggtgctctggatgccttgtaaagtgaatgaggcatgcgacctgtgtttctgctcttctctcagtagcctcccctcccagcacagcattctctcagttcccaggaagtcccctgagctgcaggcctttctcacctttcactttccttccgttagaggtggctcccactgcccttcactcccaggacccgactgagaggtgagccagctgcccaccagcagtgcttggtttgaatggttgtgatggtttgatgtgttctttttaccagggaaagttgcattttccctggagatttttgagggcagtgttagaactcaaaggtgtggctctccaaaggtgggtcacgtgcagcttggccctgccctcagtcagagaactgtagggggcacaagtcagggagtgttgcaacgcctcagccctgtgcagacctgctgtaggggtagaggctttatgctatgcactatgtagaataaagagttgaaaaactagaagctttcttttaaggagtttacaatctagctgaggacatagatgagtaaacagattgttataatccatggctatcaagatctgcaaacagttttatgtgagcagacaggagaaacatttagcccagtctgaagtggtcaggaaggcatcctgaaagagctgatttttgagggaaaaggattttaagggggaaggattggcattgacaagacatagaggcaagacacagcacaatatgaacattgagctaccaatcactactgcagttgctagggtgtaagaggggagatacgagaagaaagttggggccaaggcctaggtgaggagtttggattctaaggcagtaatgtgaagccattgatccattctaagtaacaatgaggggaggaagaggatcctagtggcaatttagaaaggtcttttcagctgcagcatggcggatggaccagaggagggaaagagggaggcaagaggctagaataggccatagctgcagctgcctgagagctggagaggcctgggccagagtgctggctgctgccttttcagccaaccttagtccagccatggatggttcactgttttgaataaattaatgggctttatatttataaacatattacagactcctcccacattcagaataagtcagagaatttttgtaaggggagggaggtcaaatttttgtaaggggaggggaaaaatgactccctattcttctcttgttatatttgctgatgtttctgggtaactttcataaatctgtggtcttttcctgcccttctgttataaacagctgacatttctgaaggggaactgagaagcacagtaactgtaagaagctataaagtgttaatcatgagggaaatgcaaatgaaaactacaatgtaatacctcactcacacacacacacacacacacacacacacacacacacacacggctatcactatttgtttctatttattcgtggctattgctattggcttctattcgtttctgcccattacagaaaggaaagtcttctcaaaaatggctgttataatttcttgggttgaataaacccaaagaggaagagtaaatactaaagaattcatccatgtaaccaaaaaacacctgtactccaaaaactattaaaatttgaaaaaaaaaataccaccttgctcctcaagaatggccataatttaaaagtcaaaaaacaatagatgttggtgtggatgcggtgaaaaaggaacaacacttttacactgctggtaggaatgtaaactagtacaacctctatgaaaaacagtatggcgattctttaaagaactaaaagtagaactaccattcgatccagcactaccactaccaggtatctgcccaaaggaaaagaagttatttgaaaaagacacatgcataggcatgtttataacagcagaatttgcagttgcaaagatatgaaaccagcctaagtgcccattgaccaatgagtggataaagaaaaatgtggtgtatacacacacacacacacacacacacacacacacacggctatcactatttgtttctatttatttgtggctatcgctattggcttctatttgtttctgcccattacagaaaggaaagtcttctcaaaaatggctgttataatttcttgggttgaataaacccaaagaggaagagtaaatacagatgtctcatttcatacaattctcagtttaattgaaagactttaatcttgctaacttctgaatttgacaacgcttaattgtgtagattcaagcttccaagctcaaagattcttggctaatgataagtataaatatatgccatggaatactactcagccataaaaacgaatgaaatgatgtcttttgctgcaacttggatggaactggaggccattattctaagtgaagtaacataggaatgaaaaaccaaacactatatattctcatgtataagtgggagctaagccatgaggatgcgaaaacatacagagtgatataatagactgtggggacttggtggggtgtcaattgagaagtgggtgagggataaaagacagcatattgggtacagtgtacactgcttgggtgatgggtgcactaaaatctcggcaatccccactaaagaattcatccatgtaaccaaaaaacacctgtactccaaaaactattaaaatttgaaaaaaaaaaaagaagccataaagtgttacagaatgctaaggaatgtgcttctatttgtttctgcccattacagaaagggaacccttcccaaaaatggctcttataatttcttgggttgaataagcccaaggacataaatagagatatctcatttcatacaagcctccatttcattgcaagactttaatctggctaacttccaaatttgacaatgcttagttgtgtggattcaagcttccaagctcaaggattcttggctaacaataatttatttggttgggttaacagttaaacctgatgtgaacatttaccctttgaaagtacatattttcgtattatagtttccaaagggatctgagaaattgtccttcctggacagacctctcatcgtcccctccatgtgatcaatagaatgcagttttccaagcaaaagctatatttctaaatcatttaagaagaaacaagtggaaatttaattttaagctggacactattttttccttttacagtcagctcatttttcatgattctttatttttcccaccagcatctttcacgttagtgttttaaggaaggagtgttttattgccaaagtcttcacaacatgaaggcctacaagcagttataaagattgggcttagatgatgtatattaaaagtgataaatcattttccagcctttcattacattttgttttctctggatccttacctcctctgactcatgtacctgggctgatgaatgcccgtctctccagttacactgtaatccagggcctgtgtttcatttgcctgccaatagtgatagccaataaattaatcatgcaaccacacaagccttgccatgcaggctgctgccagcgtaaaactgcccatcaaaagcctgcaactctgaatctccatttatctagtaccctcaagactcgcatcgttcccagcaactggagctgcaaatgctcatttcttcataggcatgggctgggaaaatgagagaaggctaattaatgcattcaagagatcctactgaatcagcaagccccttaaaggcacaacagacacaaacaggcagctgcagctccttgggattcaaaacaacaacaaaagagctagttaaatatttgaatagctaaagtatatgtctattcattcccatggaaattgctaaaataggctgtcctcccatctccagaggagtcaaagtcattgaaatcccaaagccttttatcctgtcaaacatgcctttgaagagcaggacatttacatctccataacaggccaattcaacattagtggtaataaaacttgggtgcatgaaaggactccagaatgtggtacccattcactctggcctctggggatgcagaagtaactttttgaaaataagactactattgcccaatccctgtgttagtttggcattttatagttgcaaatggtttgaacaatagtggagatttattgtttcacataaatataccatccaggagtaaatacaagcttgtatgtggcttgatgcaaggcccaaacactgtggccaggatccatcttttggctcttttccatttgggtggctcaacttgaagacaaacatttgtcttatggttgcaggacagatgactttcatccactcttgatgctatatcctccagatgcccatccagcagaaaagaaaattacggcttatgtcaaccttcgaacacacatcatagacttcgttttgatcaggccagctttatggtcacatgctcatccttgaacaaatcagtgtgggcagggattggaattatgttgatttatttatgtctgagccattggttccaccttgaatcacataggttgcctgggagttgggtgaataaccaaaggaaaatcattaccagttgaggaggaggaggaggaggtggatactggttggcagtgaaaacaatagacaaataaactatattagtctgctcaggctgccatgacaaaaacagactgggtggcttaaacaacagacatttattttctcatagttctggaggctacaagtccatgatcaagatgctggttagttgggttcctggtgagggctctcttcttggtttgccaatggccaccttcttgctgtgtcctcacatggccttttctctgtggctccagtagagaggggcagagagagagagagagagagagagagagagctcaagcatatgctctggtgtccattcttataaggaccccagccctactggattagggacctacccttgtgaactcatttaccttaattacttccttaaaggccctatctccaaatatagtcacactgaagatttcaacatatgaattctatgtgcacacaatttagtccccaatacaaacaaaaatgataatccgcagctgtgcatctctgattaatcctggtttaggtgtgattttatccactaggagtccagttgtagttgtttctatggagtctgagaataaatgtacccaggtagcttcaaatgtacactgtgaagatcacctagttatgtacccaatcatgttgtttctatttaccaactatgaatttagggaccaagaagattcctggagactgacatttagttacgattctagaactatgaaaaaatttgacaatcatcaggcaagagacctttatggaactcatctttcagtagtgcctttaatgaaaacttatgagatccacaagaaagccggaagtctgagactgtagaatcagaccctctgacgttttgaattatggtgatgtggcccagcttaatcactcatgtattccaacatacccggcgccaaatgatctttgagcacgaaaaaaatcaaattttctctccaataataaagatttgcataattggtaaactctagtacattaattcaaagataattccccaaggggagctttgaaaatatggcaaaaatatgagacatcatctttggaataaaggtgtggccttctaaggagatggcttgtcaatatgagttagagtgactttttataaacttcttgcttccctttgttgtaaacatttatatattacatattgacatacacacctacatatgctttagagactacatatgtactttcttaggcatacatattggagtctttttataagataaaaggcctatatttttatagatgaggctgctttgcaataagattcacttggaacttcactattacagaaaaagataacccttaaaacagaaaagatgatttctcctcctgctgcacatacaacacagtttggcaggggggactctattcatttcagtctctcaggaacccagaacctcatgatgctgccttctaaacaccaggcttcatagttcactgtggcaggatgaagaggaagcgaaaaacccaggactgactattcaattttctgcctagaagtgctgggtcatttctgcttactttttcattggcaaaagcaagcaccatggatcggtgggtgggggagtccaattatcttctgggcaaggaaggagaggcaagaagagcaacatctaacgtaatcatggatccgtgctataccaaatttggttctcaattgaagaatgcaatggtgaaaagttgcaatccatccaagatttattcatttattcattcagctctttagtatctacaatgaaccaggcactgtactcaatgctagaaatacagtggggagacaagacagaaatatgtattgcttttaaagaacttacagtttaggaggaggttacaagtaagtagatagctaaaaattcagagtgggatggaactatgacagagaaagaacagggtgccttggaaatacagagaatgggagacacgactaatgaatgttcctacggttgtctatctctgagctttacaattcagtctctactattttgtgggcattttatgtcctatttataaaacctttcaattagaaattgagacatctattgagtacctaccatgtgggaagtgccctgcttgatgctgttgtatcttatgaagcttgcggaagagagtacggagttgaataagacacttttctttttcccacacagagtgcttaaaatctaataggagaaataagattacataaataatgaatgcagtgcagaatgtggtgtttatcataagagacaaaaagcccaaatgtcaatggaggtatttctgatttggggaataaataaatgcttcatgataagagtaacttttaatgtgaattttgttgaataaatgagtttaatggtcaaagacaaagcatgggggttacatgtctggtggggaaaaaaaaaacaaaaaaacaaaaacaaaacatcaaacgcaaagacaccaaatctgaaagctgcctataggcagagaatgtgattattttattctactctcattacatccccagcatttatcacactgtcttgcatccatcaggtgatcaatgaatagttttcgaatgaattaataggaaaatttgaggcatctttattaaaggtatgcaaactaatagtttaactggaatcttaaggtgaaattaaggtgataaagctggagccaggtcatggggccaggtaaagattttgaatgttattgaagagtttggaccttattattcccttacccctatatttacataaaccattatgttcaccaaagctcacatgacctcaagacggtccaatcaggtggtcaggacagtaattattgccccacccaatagagaggaactcagagacagactaagtaattatggaggttatgtcaggaaataacgaatctaagactcaacacccaaggtagtgcaaactctgtttctgttcctttgtactgcattacccctctgttctgaggcagaaacgcccttttggtgttgggagcagtagaaagaaatgacgctgtcagagctgtttctaagataaactgggagagaaaggggctggcagccaggtcactagggaggagaacattaaaataatgtgggagaagaccaaactgctgtagtgaccatgagcataggcaggctaggatttctttttagcagggataaaaggttttagcataaattctacccttgttggtcaatacctaggtcagggtttcgcaatctcagtactgttgacatttggggccttgaattcattgttgtggagactgtcctatgcattgtccctgacctctgcctgttagatgctcctagcacacactctccacccaccccaccattgtgacagccccaaaatatccccctggccaaatttcccctgggaggcaaaaatcgcccccgtttgagaaccactgacctaggcaatcaattttgattagtttccagaaaatcagtggaccctaaagagcacattgggcatttagtgggaaaacatcaaggaaagaaatgcagtctcatctgatgggtttagtttccttccactgacagtgtgcatgatggcccatagttaattcgtttgaccagcattgcattttaaataatgggttttcattttgtcctatttatggtcattttatccaattatttttattcagcacccagctttataagtgtgtataatcctgttatgttctattccattatgggaacttcctaacagaagagtacacagtaatacaattaaataaacattttggctattgtgttggcctcacacatttcctgactttggctggattcgaatgtggttatgggatgggaagggagacaatgggtcactaaaaagaaagacaaaggtgctgaaaggtgacatgaaacaggtcaccatggttcccagattggtgggaagaattcaggtaccacttaaaatggaaaatatcctgtaatgagaatggagctaaaaaccttaccattttcttcctcccttcaaaattccataatacaatggcaaaaagtttcctgtgcggtgctttgcatgagctacaacaaatgttggtctagaaggactaaaaaaagaatttgcatgttttatatatgtgaatataaataatgtaagtataaatatgaatataactataaatacgtagcagaaattgcaaaggcgtttctaaacacatttaatgtggtaacaaagcttatgcaagaaagaatggagagcacggccttccttcacgctgggctcacttggtgactgggcataatggacaggtctgggcaagtcagccaagacgtgagtcattgtttaggttttccttggaaacaaaagctcctgggaatttgacatcaagtgtttgccagactctgcggacttgttagtctcctgcagggccactaacatcgcttctaagatgattccctgagaatcagccagcttcctccgcaaagacttgccctgagtgctaaccagcatggctttgcagagagaagggaatttgggacatgtctcagggagtcattcatccaacattaagacagtgttaacagggaaattgtgtgtgtgtgcaaccagacatcacctgccttccctgcagggagcttcgacagctgagaaaatgtttataaagcattttgagctctcactggggtggtactgtagaaaggcaaatctttgatatgactttctcacgtctgtcaactcttattattaagcagaggttgcccctgcctttctcaaagttccaatcatggaaactaattattaggagttgcaggttccatttttcacctacccagtgaagattgtgaccacctctgttaaagaaaaaatctttctggaatctacaagagatgtaaaaaactcagtgttgtatgtagtttaattgggaatgaataaaatgtagactcactaaactgcttttgaaatagtccacatgtacaaaacaaaagagagaaatagttggcaagtttcttctcaaaactaaatgtttgaaatatgtgatcaagacagcttgctatgttccaggcaagtctaatttcatctattcccacttgaggcttctgaactttatgggatgtaaggcttttatttttaaaatgctgcaacagaagctgattaattttcaaattaaagcaatatctgacctctagtaagtttcctggcatatagcaagcattcaataaatactgttttttttttttaattgcttttgcagagcactggccttttctcttaagatgaggatatagtggccccaaagcctctgagtattatttagcaggagaaaatctaggccggttgactgagtgcttttccttatattgcacatgatctcacattcccaaaatacccaggctcaggaaagctatataaggccatgtgtcaatcttctcagtcatatatgcctaatgtttagtcctatagactttgagaacttgaataggcctcagatgccatttctcaaattttcttttatggagtaggaaacagagtccatgaagggggaagtggctcactcaaggtcatgccgttcacttctggcagtgtctagagagggcccacatcttctgacattctagtccagctctttattccacactactgcctggagtgctggattctaagaattgctcagctttaaatactgtcttcagtcatgttccattggagagccacaaatcaggagagtagcaaatatatttgcaaaatacataatggtttttatgttgtatgtataatttgcatattggcattttcattacatttgctatatttaatattgttacgctttttcaaaattgttgttctcatccattccacaagtgtttattgagtgtttatgcaaagcattggagatagtggtaaattacacagacaagatccctgtagcaaatgctgttggcgtcaccccctgcccgtgtcctctcagctctcaccaccccagcacttgactgcagagtcttgctgcaaccactcatgactctgcataaggaccttctctgggctgggggtggtggctcatgcctataattccagcactttgggaggccaaggtgggtggatcatgaggtcaggagatcaagaccatcctggctaacacagtaaaacctcgtctctactaaaaatacaaaaattagccaggtgtggtggcacatgcctgtagtcctagctactggggaggctgaggcaggagaattgctggaggcagaggttgcagtgagctgagatcgcaccactgcactccagcctgggcaacagagtgagactctgtctcaaaaaaaaaaaaagaaaagaaaagaaaaaagaaaaaaaaaagaaacaaacaaaaaaaggagcttctcttagctggaagccttcagtcaatgacaggtgggagttggagggtaaatgacccagcttcctcagctttgggatgggataactctaaggttcattctactccatcactccaagttccccaggcatttgaactccagttgtccacagtgtaacccactggataatgtatccattacagacttcctacctctttttgtttcacttcttgactactccttttgtgcttcctgggatctcttcttagtaaactacttttgcttgaatccttagtcagggtctgtttctaggggagctggtctaagtcgctggcttcttgaggctcaaattctagaaaaggatgcagataataaacaacaaatcaataaaaaaggtcacatatgggtacctattgaaaagaatgagatgatagagagtggaaaggggttcagagaaattctgattgaagtgtgaagttggggtccctctgatagtgtgatatttgacctgaaacctgaaaaacaagaagtagttataaaaaaagagcctgagggccgggcgcggtggctcacgactgtaatcccagcactttaagaggccgaggctggcggatcacttgaggtcaggagttcaagaccagcctggccaacatggtgaaaccccatctctactaaaaatacaaaaattagccgggcatgatggcatgtgcctgtaatcccagctactctagaggctgaggcaggagaattgcttaaacccaggaggcagaaattacagtgggctgagattgcaccactgcactccagcctggccaacagagcgagactccgtctcaaaaaaaaaaaaaaaaaaaaaaaaaaaagcttgagaagaagattctgggaagaggcatgaaaaaatgcaaagtgagcaggaataggaaagagaacactgggctgtttcatggggaatgaggcagggagggggaagaccgagtaggttggccttgtcatgagagactctgtagtaaggatcagaagtttatactaaatgcaaggagaaaccgttggaggatgttaagcaggtgaatgcaataatctgatttatacttgaaaatggttactctggcagctcatgggaaacagattgggggaggaaagaatgaagcagtgagctaagttagaaggctactgaagaaatctaggtgagagatgatggatgcttttcagtttccagactcaactgttgatagagaacagaagtaaatagaatacaaacacagaggacatacatgtttatgtcttcgtctctgtgggtatttatatgtattgaagtggttcttagcatttgggggtgagaactctttgaaaatctgatgaaatctgtggatctcctctccaggaaaatgcaaatgtgcaccgacacacaattttaaatttgtgctgacaggttgggaagtcatggagtcagttaataaaacctcaagcatatttttttttttttttttgtctacatctgttagtagggataggctctctataatggtaagtaagtgccaaagtggatcacagttcaaacacatatttttgtttatggataagaattgaaggaaagatagctcagcatcattggccctctggtagaaagactctgagatgcattctactctgtctacgcccacataacaataccaagagaattcgttgttccttgaaattgccctgtgctatcttcaagccataacttccaagcttgccctaggtgttatcttaattctggccaggtagaagggagtacacagaggaagtcttaataggcaaggcctggaagtgggacccattgctctgctccccttcattgactagaatttagccatctggccacaactaaccacaagggaagctgggaaatatcgtgtagctattagcccagcagggtggggaaaaagggaaatacgaatttcagagaacagttaggaggttcagccaaatacacacatttttctttatatttgtcacataggagttgctcagtgttacatttttagagaccagtggaaatacctcacattgtaagtttgatgaaggacaagggatggagccaagtgaaagttggtcaggaggatacaataccctttgtgtcatgatttccagaaccagtttaactcaaagcaagctctcttcctacactgtggagatggggctttcttttattaaggatatgtccttaagtaaaagattaagatcaaattgaagtggaaacttggccccaaactacactgttctgtgcccggagggactggaattaatttgaagcaaactattactcaccccgattatgtgccagtaggaaagggagatgatgatactgtcaacaaggcgaacttttgcattcattttttctcactccaatgagcagtcattctagatctcagatgtgacagttcattggctactcaggcaagcacttggcctgtctactctggactcaactctggtccattctctccctgaagcaaagcagcccggggactcctctttcaaatgtcctttagggagtgggtgtgggcctaagaagttggaggtgaagtccatttttattagtaaatcatattttaccgtttgattccatattccatgacaatggtaaagtcatttttcttggggatggagggtggtgagtcttaccttaaaacataaagaaattacatttgagaacatggcaaattttaatttcttcagcgttaaaagagaggaaagctgattttctcttaacatagtaaaatgatttttctgaaacttaaaaatatccagaagctgttctctcttgagatcagaacctttctaagcctcatatttaatgtttgctcaattcagtacctacagggaaggtcaggtttcttccacgttgcctgttcccagctccttcctctgattctctcatttacatcataaatcttccttttcaaccccctatgttttagctctttcctttaagagaaatttgaaaaagtgttttttttttgccatttattttatttaatttgaattccatcttagagttgttaatgtgtttacatgctattttttcctacattccttctctccggtcagggaaaatgttgagctttcttcaacatgagatggatttaattggttaatttcataatttagagtctttcttggtctacattccaaaaggaggggattctttaagctcagtacagctacatttacttttgaaggagccctttattttgcagtgaataaagtgtctcttattaaacagaaaataaaagaaggtttggcaggactctactccccatggatgaaacatcacaggaaattgagaaattgtttctttttggccttgtgggaaaattttgcttgtgaaatttagtgttaaagttttaagacgactgcttaaatccatcaagaaagagctgttgaatgaataacagcttctagggaagaggtgccaacctgacctttctatatctggtcttttaagtgtttgaggaagtgtgcggtatgatcaagaagattgtattctctcctacataatgactgagttaattttaaacagaacttagacatagttcatcaatttaagaataattttgtcaaaagttggcctcagctgggtgctccttcatttgtgcctataagacagggcattgtacaggcccaaatgagaaacgaatcctaggtagagagtccagtttccattctcagattgatctatgggctctagaattttgatacgaagcctgtgtcttgagcttcagaccatcctgccaactgagggtgttgccttccattttcttcacataggcaccttgtttgaaatttgtggctaaaacccatgttcttggtttgactcctaaatctgttttccttctaagttccttagggactctgtgggcagcataaccacatacttagttgtccaaatctgaaaccttcattgttttctctccacactcccctcaatttgcaatcaatcaccaagttctgctactgtccctaaatatgcctgcagtcatctcctttctttcaccttccccttccccaatacccagttcaggccacaattctctcatgccttgatttctctaaaaacctccttaaccaatctcttgccttaatttttttcctcccataatcctgatttcaccctgcagccaaaatgatttctctaaaattaatctttacaatgttacttcctggcctgagtgttttttttgtttgtttgtttgttgtttttttgcctaactgtgcgattttcactataatatccaaactcttgacttggcccttacttgtacttcccatttccctcccccaaccccccttccagctgcatcagcctctggacacattcagcacttctcaccttagccagagctgtattctgagtgcagtcagtgttccttcctctgctctttcccattcttggctaattctaatctattttctagaaatcctctgagccctctttctcgagccgcctcccaaccctccgttggaatagaggcttcttttctgtgctcacacaccctggactgacttcttggatggctcatcctccaccgagagcttctcaagtgccgctttgcagctcatttctctttgaagactgttctgcctgataaataaataaatgagaatgaataactacttagtgtttttctatatttaaaattgaatcctaattatactgttttaaaattcagttaattttggtgattttggagcatgggaaatgcaactaaaaaagaatgaaaaaaaaacccactatgatttgacatcagaagatatgaatcctggctcagtgaccacgagctgaaagatttgctaagtgtatcagcctccctgaatctcagttcctcgtcaataagcataggataatttctcatgtaaacaaaggttggctgaggaccaaggaagaagtgcccggtgggtaggtggaggcactcagtgaactataatgacttcacaagtgagaggaattcttatttgctttgtatctgcaattctcattgtacctgtgcaaaactccagcttgggagaagcggggtgtgaatggtttcatggggcacacgatgggaggggaatatttgtgaggtctcttcccagttaggtggagccacaccaatggtggggaattcagcaattcctgtaaggggaaattggaaattgtgcgtctttagttttcccgttgggtagagctcaaaaacacacttctaccctctcaaatactgttggtgaaagtgagacctggcatagtgttgtagcaatttgataacctgtattgagaaccttcacaatattcattccttttgaatgagtaattcaatttctagaatttatctaagggaattatttttaacaagagaaggggagcacttaaggtgtgtaaagatgttcattgcagttgtttattatagttaatgatcaaaaataatctgaaatgtgcaatcagtgagggaccatgatcacattgcccttcagtgagttctctaaaatgggaatgtaacattgaaaaacatcttaagtgaaaaaaacaggcttaaaaaattcaatctatggtttaattaaaagtgtttaaatcaaacaaatttaagaaaacaaaagatgaccagtgggaaaatacactttgttttaaatggggttagttgtaactaagaaatccataggcaggactctgcctccctagactaacagctccaatgactgaagttcactgtcttctgtgcaaaggaatctttatttggctttggctcaaggctaggccttcatctcatcttctaaaacctagaaggaagctttcagaggaaaatatagatcagaagtaaaattcggattagaagttggggggctgaagttgtaggatacgagggagggaaagcctacctttacccttgaacaatcatcatgacaacaacctcctaagtcatcttgagtgtgcaaagtgcttttctgtacattgttcatttaaattgattcctcttcagtttagctagctaattatccaaaatgtctgtaaaaattatgacagaggagggaaacacagttactgatttggggtccattccctttacccttctcatattcaggtatttccccactgtgcagaattcactttgaatccagcggaaattacctaggaggaaagagctgggctcaggaaggaagcagacatttcactgtggctttattcacgggaggctctccagacgtttggcaggtcttttcttacatgtgcctactggaccttgtgttctaagaggcacagaacagctgtacacagcccagtgtcacacagcaagtcaggagcgagaatccatgtagaattaagatctttttttccctccctcctgaatctctatctagcccgtgtctactctcccacgggattttgtgttgctttttttaccgtctgtctcagcttcaaaaaggatctgttttctcttattattttcccacattgctgcggttcagaaccgtagtgcatttgtcaaatgcattgtgtgtgtcttcacccctgcagcttccctgtcagatgattcaatacaaggcaatgatctctccactaagggggaagaaagaaagtgagaaagaaagaaaacagctcagagcccttaaccctgggttgtggctatttttctcatagacaggctgctctctcttatctgattggagcctccgtgttctctgaataggaaataaatctctacacaaaaatccaagggttagtttccaggtgtttgataggaagctttcatcccaagtggtttgtttatttatttatttatttatttatttatttatttatttttgtcggggggagtttgttgcattatttgaccaaggacagtgttgaccacctccggtttctacttctctttcgaagtttattttatgttttgttgtggttttcagatttctcatggtttggatttgggaaagtaaaatcaagacaaggtgttggtaagtagttaactcactccttctttggataagtaatgagtctatgtttttattcggatgaaaatgcttagaccctctttacattccacggtctttgattcattttctgtgttcctggtttttgatttgttgaagaagtaggtctagaatttttccagaaaaggcattactgttgttaattgagtttagtacatggttttacatttttagatttgactcgtttttatcctgtgggggaagtgttaactgtcgttccagttctagtttgtgatgcatttttaagaaggttaaggaaataaatacaactacatttcagctacatgtacagggaatagctgactgaatagtcaagctggacaagtttaggtcttaactttcttccattggccaagatgtaatagagttctgaattggtaaatcagtttccatttatgaccattcctctttcaaaacagattctaacgtccagacgctgtgatttctgcttgattgcattctattccctgcattcagactatgtgctgacaattgaaaagcagtttgtagcttaccaagtgaatgcagatgatgtagctcctcattagaattgaaatcaggtgtgatctcttgggacctctaatttgttcagaattttctatgggtacagagacaatgaacaggaattgcttagaaggcatgaaaagacggcattcttacatctttcatgtgggtttccaagatccgaccatcttgggcatctgttggttagttattcttttggtagcaaggttggccataggtaaaatggcaaagtaggggaaatgtaccaatgtcaggaggctgctcaattccaaaccatccaccctatgcttgttcatcctggccatataaggagctgtttcctgtcactttccatcctgacgtcagaccttgtcttgttgggcagtctctatcactgtctgtccagtgatccaaaaatgaccagccggctgaggcagcctggccagatggggcctggagggggaaaagtcaccttgactctcgctagctccatggattccaaggttaaagttcttaaccagcaaaggggaagtggagacttggcaaagttagaacatgaagctcaagtagtcagggcttctaggcagctccctaggggcaaatttcagacacagctgatcatagtcactttgccaagatatcagagggatgatcctgcctgggcagtcttaaaggtgttctgttttacgggtttgatgtgtatgcgtgcgtaggtgtatcccgtgtgtttttggggaaggtggtaataaactctcccatgacagtcctataagacagggtcttgcttctgctaaatagcaagtcattgcaaccacttaaatatttttccaagccaatttgcactgcagaagggtgcttgttcccggaaagctgcaaaaatgtggttttactgttttaggccacagcagagagctcttcagaattattcttccggctgcagtccagcagaggtgctgctcttataaaacataggtttcattatttttcaagtttggtgagaccaacaatttaggagatgattgccattgagaagatagtgtgtcactcgtggttcccaaaagaaaggggcacaccatggcatgcagagccacgtggggaagtgctgggatccattaaaaggcagaggagggaagggagaacttgggcaggagcttttagtgtgtttccaggtaaggaactggggagggagggtaaacaggtttaggactggctagtctgagtaacttcaacaggctctagggtacaggagctatctagagttgtcaagtacttggccctggggtggggagggcaggtggatagtggcctagagtgtgagcctcacatctggaaggtggttggggtgttgtctctggattggttggtttgcatttgaaaggcatgctcccaggcagggtatttaccatctgtaggaactgactcaccaggggtgggaggggccattcctccaggattagcacggccccagatgtcaaagcaccagaatccagaatataaaaaggcttgcttagtacagctgctcaagagtactaacccttcccctcaccttgaaggcactgttggtattgagagaagaaaactcccccagatgaacttcgtgattcttatcacaggaaattaagtctacatgaggcttagaaatgtctgtaaagtcatagtacaggatgtgtgaccaagcagacatattaaaataaaaatgggctaaaaatgtttccagacttaactcatgtttttcagctgagtaattagaactatttaccctaaatcagccaagtgtgcacctacctcgccatttaaaactttatatgaatattataatacattttttcaagtcctcatatgaatttcgtttaacacacggtgatgtgcccctttattcttctgtctttttcatggtgcctgctcaaacacatgcatagacatacaaagacacatcctgtgatatgcacagacaggctgctgtcaaattatgtagacattcattgtcccgctgagagcttcttctgccttctcaactttgctgtgctttgcattccattatatcaaaatgttcacagaaaaatgggcttaaaccctgcaaccttgccagccatatcaatcttctaggttttggaacatcaataatgaagaaaacagcacttgaattaatatcccccttgatgaattgttgaggtttatgtgttactcacatttgtcaacagtgatttttctggcaaagtgaaaaggcttttgaaaaattacctgtggtgctttttactgcttctacgcttaatcctcccctcgctccccaaacaagagctcattcccttgcaatctgttacattggagttggggggtttaattggagaggtttaggaaaggaaagggtatcccttagtgaggaaggagaagcagagagcaaatcacttggttggactctttaagtgagggcttcgctgtgtacttggcagaagattcaaagtctgaatttgggaatctcaagttgtcttctaggtatcagcctcctcaaaaatgattgaatgctgctctgatgttcatgaacttcagagcatcctgggccagaggagagtcagagaagaaagcaactggggtcaatgcatttctaatggttccaggggctccagaaggaaatattgctggatctctgacagcacgtggagtcttttaaaatgaaactcctgtacaaaggcataagaatgataccaaggacttccgggactgtggggaaagggtgggaggggggtgagggataaaaggctacacattgggtacggtgttgctgcttgggtgatgaatgcaccaaaatctcagaaaccactaaagaacatattcatgtaaccaaacatcacctgttccccaaacaactattgaaataaaaagaaattttaagaaaaagaaactcctgcatttctgggggtaaaggtggtgcctggaatctactgagaaacatgcagccttggctgcagtccttcagggagcgcaggcagtagcatgttttagtaatcttgcaggagggaacagccatgccgggaaccaaggaagggagtcagtggtgagaaggttttgttgacaagatgcggaaaccttagcataacacatcttaattttcttttttttttttttttttttttgaaactgagtctcactctgtcacccaggctggagtgcagtggtgtgatctcagctcaccacaacttctgcctcccaggttcaagtgattctcctgtttcagccccccgagtagttgggattacaggtgcacgccaccacacctggctaatttttggacttctagttgagacagggtttcaccatggcggccaggctggtctcaaactcctaacctcgtgatctgcctgcctcggcctcccaaagtgctgggattacagatgtgagccaccatgcccggccaacacatcttcatttttaattgatggccagaagctggatgatctaggcctgtcagggagcaagtagcagaacagggatgattaggagtattggaaagaacttgtctttgtagttattcttggcaggatttctgctgtatcctaatgcaggtgaactaggcacaagacgaacacaactgatgggtttgcctttgcttttgagtgttctgtggcttctaaattggctgtgtgaggacttgtttgcagaattgagccggagcgcatcattaaaggcagcttcaatgcacatccccttgagagaatgcttcaaaaattacctataataagagttggctgtctcctgcatagtttgtttaagacactgcttagctggggaatgtccaactgttatcactacaaactgtgataatctccatatgagggggaaaaatggatcttggaggttgggggatgagatattattatatttcataggggattcaagactggatgacaaaacaacttttgttttcagaattgctgtgcttctcactaaaatagttaagtgtgagggaaaaggtaaaggatggaagtgctgaaacatgcatttagtagggggggttggaagaaagcacatttccttgcgtaggaagtagcaattcagacatttccctggcatggcatttgccttggctgggcatttgattctgccttttcactccctattgtcttttctctttattctttctctgggcttgtgccagtagtcgggtcagtggtctgcttccatgggaccctgcctgtgtaatacatatcttgtgcacctcccacgtagacagtgcctgtcatgagccactgccgtcttcgttggtttgaagctttcacgtagacctttatctttgtgcatctaattttggttgcaaacagtatgagtttagtggctaatgggtaaattgtttagacaagatacagtagactgtatgtgtgagcatatacattctgagactttgggctagaaaatttgtcttgtacaaaaaatgctatgattattaatttagtataaagacaccaagttatgactataaatagtattacagctaacaacaaagcaggtaactttgccatgggattgatccattattgttataaaagtattttgtagacaaaagtggtgcagatactcacagaatatgaagaaagaggaatgtagtcataggacagtcaaatgtatatctggtctaccagttaaagttcatttagtaatacctagtattaatacatactcatgaagcatatttaaatttataatacattttcctgttactaatctcgttctagtgtcataaaataagcaaatattattttgcatataagtcgatgtagaggtccaaagaaagtaagtgacttgtccaaagggtagagaaaggaaactcagatcctgaaattcccagaacaactttcaatgctctgtgaaatagggatcccagattcatgttgacagtttcaatgacagagtgttctagagacaatcatagaacagagaggaaagctacgtattatcttacaggagaaggaagtgaagaaattggagctctcatacactgctggtgggaatataaaatggtgcagccactttggaaaacagtttggcagttcctcaaaatgttaaatatagagctaccatatgacccagtaattccacccaagagaaattaaaacacgtgtccacataaaaattcgtatatgaatgttcatagtagcattattcataatagccaaaaagccagaacaacccaaatgtccaccaacagatgaatggataaataacatgcaacatatccacacaatggagtattattaggcaatacaaagaaaggaagtactaatacatactacaatgtggatgaatcttaaaaacatgatgttaagtgaaggaagccagttacaaaagaccacgtgttatatggttccattcatatgaaatgccagagagatagagtgtaaatctgtgaatgtctacggctgaaagtggagagaatggggagtgagtgctaactgggtgatgaaaatgtcctacaagtagattatagtgattattgtactactctgtgaatatactaaaacccactgaattgtatactttaaatgggtaaattttatgtatgtgaattacagctcaataaagccattgattacaggagaatatatatatttttccatctccaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatgtaagtacagctgtttgtacttattgtcccatttgctgcatagctgtatcaaccagagtgtttatcagagcccctgatagggatgactggcggggaacagggtgcagtgaaatgtttgaggattcttgcagcttttggcccaggaatagatcctttagtttgttgcttatggaattctccgggtgtgtctcctgctgggaagggaactgtgggcagatactgactctcttgggatctattttccaaaaccatttgtcaatgtgaagttggaatcaaggcatgcttatcttgaaaaagagagacagaaaccagaagtgtcatttgaatgcacatatatcagttatagatgacaagcaatgaatgtaatttaaatttagcctatagaaagtaattgaaatatgcactctaggtagttgggaaggcactgtgttgcccacaggtggtatcagtttggggagtcctgtattctttgctcagtccgagttcccagcatgaggccttgttgtgttgccacaatagcaaagagacatggcagcagatgatttgcatattaagtacacttactttcatttttcaaaaacaaattaacccattaatctctgttagcaagcttgagatttttctaagggccttttgtgctatcttctgcaccactgctccaatattaaatgtgtagcacagccttaaagacaacaaaaaataaacccacagtggacaaacaggcttatggcattgcttccaggccttccttcatatgtgaataaggggccgtgagggctatgatgtcagatcccagagattccctgccactaaggagtgggtatcatgcatgttcctatcctgtcttaaataccattctcctaccttgtcatagaggtaaggtagaggattactgcaagattaggctttgggggctgcctctctgttgagagctttcatgggatgaagggccttagcaatgagtatcagatctgtgcatatataaggaaatatctgtaacttcatcctattcactcaaatttatcccaaggcatgtttaaggttggatatgagtttaaatgttaggaagaacagtattatgagcttttaatgtgtgagactggaatccaccagagattttggttgactctgtaacatgacaagataaatagaataatgtgtgaagaatattgagctccttgaaataaaaggtattagttgaaattaaggtattattaatcttaatactgtcattgtggtgtgaacaaggtgagtagaggcattgcttaaaatgtgccttctttgatggggtgagcctcctccaaagatccttggaatgccctgtacacagaactgtcaaataaggagtaagactaagcaggatactgtgatgggagcatctgtcatcattttgattgttctccctaggaatagagtactttgacattgacacctcagtcaccacccgaaccaggcctatgatgcatttcaattagcctgaggctgtagtataattgaggctgataaaatcaacataccctcaaaaagttgctttcctttgtggagggaggaaagataaagctgcataattaagtagacccgatcagcccaacaagtccagtaagagaaatcgaacaaacgagcaagagagcaaacaaacaaaataacaaatgagatcctctagtcaaaagtgggctacatgtctggaagtgctttcttcccttagaaattcagaaagaaagatttcaaaggttatttccttaatctggagtctgtggagattttttgcaaaggtttgggttccttttggagcagtcttgattgtgtggctcagtcattctgtgcctcctgtcagtttctggcctctacccaaatggccaacctccatttggtcactccttctgtataaagtcttgctaggccctgcacccaaccgcaatgtcccagcttagtgtcctcagtcactccacaccatatatcaaacgagattttcatttttccaggcaacaagtcactatactctttcatgattt

SEQ ID NO: 14446 - DNA, 12921 bp, Human
  misc_feature (1)...(12921): n = A,T,C or G
agcactttaggagacagaggcaggaggatcacctgaggtcaggagtttgagaccagtctggccaacatggtgaaaccccatgtctactaaaaatacaaaaattagctgggcagggccgggcatggtggctcacgtctgtaatcccagcactttgggaggccgaggcgggcagatcactagatcaagagatggtgaccatcctcgctaacaccgcgaaaccccgtctctactaaaaatacaaaaaaaaaaaaattagctgggcgtggtggcgggcgcctgtagtcccagctactcgggaggctgaggcaggagaatcgcttgaaccggggaggcggaggttgcagtgagctgaaatagcgccactgcactgcggcctgggagactccatctcaaaaaaaaaaataaaattagctcggagtggtgtggcctgtgcctttgagtagtcccaactactagggaggccgaaatgggagagtctcttgaggccaggaggttgaggctgcagtgagctatgatggtgcaccactgcactccagcctgggcaacagagtgagaccctgtgtctaaataaaatgaaataatagaagagagggtaagagacaaagagattactgggggaaaagtctaacccgtctttatttggagttcaggaacgagggaaataataggtaaaactaatacttgaagagataatagctgataaatttaataaatggacgacaaacctgaagccattgattcaagaagctcaacaaacctcaagtaagatttttttttttttaaacggagtctccctctatcgcccaggctggggtgcagtggcgccatctcagctcactgcaacctccgcctcccggattcaagagattctcctgcctcagcctcctgagtaactggaattacaggcgcccgccagcacgccggctaatttttgtatttttagtagagacggagtttcaccatgttggccaggctgatctcgaactcctgacctcgggtgatccacccgtctcggcctcccacagtgctgggtggccacaagccaccgcactcggtccgctttttgtttgcttgttttttaaaaattaataatatttattttaatctggatggtggttacgtggccagaatacgtttagacttaagatgtttacgttctgctgtagtaaattaaatatcgaaaaagtacttatggaagggaggtaggtgagggataaaagtctacaagttgggttcagtgtatactgctcgggtgatgagtgcaccaaaatctcacaaatcaccactaaagaatttatgtaaccaagctgggcgctgtggctcacgccggtaatcccagcactttcggaagctgaggcgggtggatcacctgtttccatggacatggaaaaccatgttttccacactaattcaatcaatatactcctctcctatctaaaacctgtttctcctgcttcgagtttgtagacgtgcagtgttcatagttgcctaaactcccttttccccatcaacttcaactgctagtggcaaaaatagctgatattggttgcatttttgaggtaggaaaattggcaagatattttccttcactaaagaaacgtagattacgtatgccgtacagggcaatgaaaaaactccgatagcagaggatggtttcgatccatcgacctctgggttatgggcccagcacgcttccgctgcgccactctgctatctagaactaaaatttctcatgattgttatagaacactacgtagtcgttgtcctgacttctttagtgccacctaatgtctgatcaaaaattcgtcattactatagaaccagttcttattggctagttcctgacacagtaggcgttttttattggttcataagcccggtttgacaaagtaagccaataggcataagcgatggggtaaggcgggagccaatcgcaccgggttttattgggacacgccggcaagacgcctcttcagttgtctgctactcagaggaaggggcggttggtgcggcctccattgttcgtgttttaaggcgccatgaggtaagtgggtcgaagcggtcgaaaggtttcaggtattcgacggaaaactttgtgaacgtgggccgaaagaagtcggagtatcagaaagggccatgtatccgggggctggccaaaaacctgagaactcctggtctaggatagtgggagagatggaggccggtagaggcggggaaacttgggcccgggatggggttcgggcccaggagtggggaggggggttcgacacctttgtctctgaagggttgcgatgagggggtgtcctcaagcccctggaggagctccccacctttcccccgcccccgtcatccgggctgagaatgctggagcgagccgcattcatcctcagtgcgaaggccttgacattaggacacgcccgataaatgtgtaccttagtgaagaaatgagcaatctttagcctccgaagtattaggattcgtgtggcccaggattatgggttattaagtgtagggctcactgagccccaccattacttgatgggggttggattaacttagaggaggttatgggggtgtaactgggcaccatttggaatggggagaagtgtaagtgtgagtggggtctcttgcctaccgttgggaggttccgagggatgaaagtagccaacctaagatgatatggccggtgggtattccttcaatgaggtcaaaataaaatctgcatttctaggggtgacagaggccgtggtcgtggtgggcgctttggttccagaggaggcccaggaggagggtgagtaccagcttttagcatctctgcacttggttgttagtttctgcttgtcatctaaataggagttttagagtagactaatgtcacttggttttgcgagagccaactgtggtcttttcctgcactcctgttaaatgaatttggccccactatgctaagaatgattctttccctccccggagactttgtcactcattctgaggactgacatgttttcaaaattgttggcgtgttatttacatctcgcttgattcctacctagggaataatttggctgtttttcatgttttaggttcaggccctttgtaccacatatcccatttgacttctatttggtgagtaccttgggttaatgatacacattttctggtcactgttgaaatggagcccagtatctcccagttaatgaagttagatggtggttgaagagggcagacacagtgcctcacgcctgtaatctcagcactttgggaggccgaggcagatggattacctgaaggtcaggagtttgagactagcctggccaatatggtgaaaccccgtctctactaaaaataaaaaagttggctgggcatgtgtctaatcccagctacttgggaggctgaagcaggagaattgcttgaacccgggacgcggaggttgcagtgaaccaagatggcaccactacaaaaaaaaaaagatggttgaaatagggagggaaagtgatttgtgaaaagatttggggttttgagtcaactgtgtgttgctttacatacagaaacagtgtaagcatggtggggagaataattcccttggctactgttggcattaaacatgattataatctttgttctgaacaagtaattgtatttatggtatatctgttactataaagatagtgatagcttaaattatggctattccagcttttatccttgtttgaactttttattttttttgagacagtctcactctgtcacccaggctggagtgcagtggtgcaatcttggctcactgcactgaacctgggaggcagaggaatcaggacctctgcctccagggttcaaacgattctcctgcctcagcctcctgagtagttgggattacaggcacctgccaccatgcccagctaatttttgtatgtctgtttagtagagacggggtttcaccatgttgcccaggctgatcttgaactcctgacctcaagtgatctgcccacctcagcctcccacggtgctgggattacaggtgtgcgtgacccactgtgcctggcctttgaataaatttttttttttgaggcagggtctcactctgttgcccaggctggagttgcaatggcgcgatcttggctcactgcaacctcgcttcctgtgttcaagggattctctcacctcagcctcccaagtagctgggattacaggtgtgagccaccacgcccagctatcacctcagcctcccaagtagctgggattacaggtgtgagccaccacgcccagctaattgaacaaattaagcagtaaaaacaagtgtagaattttctgtttttaacctttttctgtcgtagtaatagaaaaaacaatctctcctgtatattatcttcggcaaatagaatgtagttgtttacttctggtttagtgtgaaatggcctttccccgggtcaagccagcacctgatgaaacttccttcagtgaggccttgctgaagaggaatcaggacctggctcccaattctgctgaacaggtatgttcttttggctgtcttccagaaatgtctctaaagcagttaaaagtattggtaaagagtaactgttggtaaggttaagaatggtgttaacagagcctgaaatccacaaagggtttaattgttctccttatttctcattgtgggtggagatagccaggtggatatataaacaaattacatatgcattcttatttttactggggacaaagagttgttctcttcccatatattcaaggccagaatgaagtgtttttaaagccttatgtcagtattgagtcagcttgtatggaagggattaggagaaaatattcaaattctgagaaattgcttataatttttcattttcaagtattgtttcatactgtttttcaggcatctatcctttctctggtgacaaaaataaacaatgtgattgataatctgattgtggctccagggacatttgaagtggtgagtttttgatgatttagttttaggaaagggcagctttggtagtgtggaaattgccttggctcttgacttttaattttcagttgtctattatccaaagccaagcctaaaatgagaaagtacagtggaatttctttgtagtactgatcttggggacaagacttgtatcattgttatgctagctgtgatgtatcaggctttcatgtggtggttttgggggtgatttcacctctgctacttcttaatttgggtaacaggtagctgtgttgtaacagttctgggaggacctaggcacctttttttcttctaaattgtttttccccgaaatcctttttccaacagcaaattgaagaagttcgacaggtgggatcctataaaaaggggacaatgactacaggacacaatgtggctgacctggtggtgatactcaagattctgccaacgtgtgagtgtgcctgtttctggtcatgggaacagaacatagcacttggattaggggtttaggtatctttttttgttttgagacaaattctccctccgttggccaggctggagtgcagtggtaccattgtagctcactgcagccttgacctccactacagcaagtgatcttcccgccttagcctcccgagtagctgggactacagatgtgtgctaccacacccagctaatttttgtattttttgtagatacagggtttcaccgtgttgctcgggctggtctcaaactcctgagctcaagcaatctgcccacctcagcctcccaaagtgctgggattacaggcgtgagccactgtgcccagcccttacggatcttgaaagctcaaatttcttgtgagaaaggatgtttgtaagacaaatgtttctagtttttgtttttgagacggatctcactctgttgccctggctggagtgtaatggcgtgatctcggttcactgcaacctccacctcctgggttctagctgttttcctgccttggcctcccaagtagctgggattacaggcaagtgccaccatgccaggctaatttttctatttttagtagagacggggtttcaccatgttagctagtctggtctcaaactcctgacctcaggtgatccgcccgccttggcctcccaaagtgttgggattacaggcgtgagccactgcacccctgcctgacaaatgttttttaatgagtgataagggacaaacgctggagtgtgtgtgtctgaaagaatgtatagcaggttactgtacggccatgtttctcaactggaggtaattttgccacccaggggatatctggcagtatctggcggtacttttgattgttaaaacaagggggtgctactggcatcaaaaaagggtagaagccaggtgtggtggctgtattcccagcactttgggaggctgaggcaagaggatcacttgaccccaggagtttgaccagcctgtataacatagagagatcctgtacctacaaaaagaaaaaaattagctgggcatggtggtgcatgctttggtcccagctactcagaagcctgaggtggggccgggtgcagtggctcacgcctgtaatcccaacacttagggaggccaaggcctggagttcaagaccagcctggccaacgtggcaaaacccagtctctaccaaaaatataaaaattagccaggcgtggtggtgggcgtctgtaatccccactacttgggaggctgaggcaggagagttgcttgaacctgggaggcagaggttggagttagcagagatcgtgccagtgcacttcagcttgggtgacagagtgaggccctgtctcaaaaataagaaaaaaagaaaaaaaaagcagcagcctgaggtgagaggattgcttgagcccgggaggctgaggctgcagtgagctgtgattgtgccactgcactgcagcctgggtgacaagagtgagaccctttctcaaaaaaagaaaaaggatagaggccgtggatgctgttaaacatcctacatccccatcaccccaaagatttgtctagcccaaaatgttattaactgccactgacctgaaaaaccctgctgtagaaagaggatatgagtacaggaggggtcctgttccctgagtcttccaatttttctgcccaggccttggctttctcttataaaagtatatattctattacttacccttgcttcagccttggatatgggacagaaatgagagtgcaaagtagcttagagatacatagaaagtctaggcaaataaattattataacattatgtcattttctgtcaattagtggaagctgttgctgccctggggaacaaagtcgtggaaagcctaagagcacaggatccttctgaaggtttgcatttgttgctgattctgtatttagtagccataggaaccaggtcttgtaattgtaagtacactttcaacaaaatcagatcagaccagatggaagagtaaatgcagagttttatgttgtgggagtttttggcaggggcttcaggtgttcaaggtgttcaagggagatctgtttgatctcccttctaaagctctgtattctaaattctcattctggactttgtgctgttttaaaaaatccacctgttcccccccaccctggatttaactttgatcatctaatggaaatgtgagttatagtttttgtttattctgttttttcagttttaaccatgctgaccaacgaaactggctttgaaatcagttcttctgatgcctacagtgaagattctcattacaacagtgccacccaatcttcgaaaactggatccagaactccattgttagttcttttttttccattgctggaaaatttaggggatattcaaaacatggtattgttgctgtttagtttacttagtttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgaggcaggcagatcacctgaggtcaggagttggagaccatcctggccaacatgatgaaaccccgtctctactaaaataaaaaattagtggggcatgatggcggttacctgtaatcccagctactcaggaggctgaggcaggagaattgctcgaacccgggaggcggaggttgcagtgagctgagatcacgccactgtacgcaatccagcctggacaacagagcgagactccgtctatcctgccctccttccaagtttttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaatgcttctcagtccacgtgagtccctctctaaccatttggattaagataaactttttaactgcagtgaatagcaggatacccccatacttcctctgacagaactattttgcctgtgacctcgtgtctggatttttatttttaccttaaggaagcaaattaagatttagagaaagcagagaatgtatagttctggaaatagcatagtcagcttcaattctaccttaggcatggaaatacatgatcgtattgattttaatgtttgggtcactattactttcagagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaagtgaggccctgtctctaaaaaataaagttctagttatcagaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttttgaatactgctgctcagcaggcaaagcggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctgtgagtgaccactgtgggtcaggggttttgtattgtaatctggtacagagaagctgtacactacttaaatgtctttaatatttccacagtgtaagtaatgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcctgaagaaggtaagcctcaagtatgcagcttaaaaaaaaaagtagaggcctcagctcatttgtgaaaggaagcaagagccataattaatgtaagtcctttgggaacctcattctggctgtgtgtaggtttcctggggcccctacataaatgggtaagacgaagtgcttcaaacaaactgtacggctccctttttaatgtctgaaggtctatggggactgtctcctaggatctttgcatgtctgttgaaacaaggcagctggggaacagtacttgtgctactgagtccataggctcatctgttatttgcctggggagccaggggggtaaattcccgaatccagcattgctctcctgcgggctgtttccttggcaacactgtggtttagccgtctcagtcgttcctacaagacaaggaaggtttggaatcttaaccactgtgaaaggcttgagagtgtaagtgaactaggtgctgaaaaataccgggcgtgatctacctcaaagtcagtcttcaaaagtatatataagaatgtaggccgggcatggtggctcacacttgtaatcccagcactttgggaggctgaggcgggtggattacctgaggtcaggagttcaagaccagcctgaccaacatggtaaaacccgtctctactaaaaaatacaaaaaaattagctgggcatggtggcgggtgcttgtaatctgaggcaggagaatcgcttgaaaccgggaggtggaggttgcaatgaaatgagatcgtgccactgcactctagcctgggtgacagagggagaactccatctcaaaaaaaaaaaaaatgtaggccaggcatggtgctcatgcctatcccagcaccatttaggaggaagtggcaggaagatcacttgagcccagtttgagaacagcctgggcaccatagtgatagcctgtctttttttttttttttttttttccccgagacggagtttcgctcttgttgcccaggctgaagtgcaatggtgcgatctcagctcaccgcaacctccgtcccccgggctcaagtgattcttctgtctcagcctcccaagtagcttgggattacaggcatgcgctaccacgcccagctaattttgtatttttagtaaagacggggtttctatatgttggtcaggctggtctccaactcccaaccttaggggacctgtccacctcggcctcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14447 - DNA, 11242 bp, Human
  misc_feature (1)...(11242): n = A,T,C or G
ctccctgaagctggcaggccagggactagcccagtggggcagggtactcacggttggcctgggcctgaggtgggagcaggttctggacagatggccaaggttgcaaatgtggctgctggagctgtgtgtggagacctgtcttcaacagtccctcccccgctgacccccccaccgactccaccccttcacagacgaacaccctgtggggcaaggggccaggagcagacagaggcgccctctgtctcctgggctggaacaggcggcccttgtctctttcccagccttgcttgccccgttcctttctctccaggcagcagtggatggtgcaggggaaagaggtgggaaggaggtcctgggagggacactggatgtcttaccccaagctgggccttgcagtacctgtggctggctgtgctggttgagcccggtaaggggggaattctgctgagggggtcttagtctgtggctcctccatggggcctcactgagaggaccctcagtgagaaacttagtcttgggagtctgagaacccacagagggatttcaatccaggactcttctctgggggtctcaacctggatccccctctgtgtgtggggcctcagcctggggttctctgagggatcttggtctgtagcatcctttgtgggatctcattccaaggggcctctgtgtgtgtctcagattgggcctctcagtgttgagctcccttgattggttgcctccctcttcccccctcagcatacacactcctgattagacatgggtatggtggcagcagcccccagtattgagaggactaggaccctgggacccctgccgaacgagatctgtccaggcagctcctctccctgaccaagtgggggcgctcgtgtggctggcagggagcccgggtccagacctgagggctcagggcaagcggcctgattgggctgtctctggtcttcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtgagtctgggtgagacaagaagggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggtaggcagaagtctgggactgagattttgtgagatgatgattatgggacactgtgtttaggacgtgatggtgccgagtacggtgaggtgaccacaagaaagggtgtgggtggctgcatgtgtcaatggttgcaggttttcttttgttttttcgagacaaagtctcactctgttgcccaggccggagtgcagtggtgtgatcttggctcactgcaacctccatctccggggttcaagtgattctcctgcctcagcctcctgagtagctgggattacaggtgtgtgccaccacgccgagcctatttctgtatttttagtagagacagggtttcaccaggttggccaggctggtctcgaactcctgacctcaggtgatccacccgcctcggcctcccaaagtgctgtggttacaggcgcaagccactgcgcctgacccggttgtgagttttcttgcctggtgtgtacatgtgtgtgtttgtgtgtccatgcatataattaggtaagcaaagatactatgtgccagtgggagtatggtcttgtgtcagaagatgctgttgggttcttgtgtatgctctgtgcctttctggtctaatttccccaagacaggactggacccagagctggcttccaggagattcacagactgtcagagctggaaggaggccaagagaaaacacagtccgcattcctcacttcacatatatggaaactgaggcctagcagtggaaaggggcttatcaaaaatgaaaacacagccaaattcatggagtcatagacctcagtgtagggggtctgtgggtgcatctgtgaagactccctacccgctatgggcatccccttactagggtgtaagagtcattccttctctcgcactcacaggctggagtcaggtcttaaatttcatcgactctggcctcgaagaggcctggtcattctggctgttgacagtttgttttacatcctttctgaaaatccacaggcacgttgaagtgtgtgaatatggactccttgaacacagtgagtctctgaaactcatggtctttcatctgcaaaatcccctacaacttccaacttctcagacttttttttgagacagggtttctcactctgttgcccaggccactgtgcgatcacagctcattgcatccttgaccttccgggctcaggcaatcctcctgccccagcctcacaagtagctgggaccacaggcgcatgccacactgcctggctaattttttctttttttgtgacagagtctcactctgtcaccgaggctggagtgcaatggtgcgatcttggctcactgcaacctctgcctcctgggttcaagtggttctcttacctcagcctcatgagtagctgggattacaggcaaccgccaccatgcctggataatttttgtatttttagtagagacggggtttcactatgttggccaggctggtttcgaactcctgatctcaggtgatccacctgcctcggcctctcaaagtgctggaattacaggcgtgagccaccgcgcctggcctaatttttaagttacttgtagagatgtggtctctctgtgtttcccaagctggtctcaaactctaggcctcaagtgatcctcctgcattggccttccaaagtgttgggattacagtcatgagccactgtgcccagccagacgtttcctttcatcttttttactggaaacttcaggttctctcctgaagggacagcattccttatatccttgtcaagcagtgattgtggttttttttttttttttcctaaattcaacttcctctgggcctggaaatggaggaagtgacctctctgctttccattatctctagattttagtttcttcttctttctaagacttcccagcgccttggaagatcatctgccacctgccattcttcttattgcgctccttacagctcttcagctcctggctcactgttttcttctcatcactgcttctgttgttattctcagtggcttcagcatccgcacagacaattcatccaacatctgggcctttcaattttctcaactcctcatttccaaaaagatttgtcttcttacatctcagcatcccactcctctgttcatgctttagactgtgtcattaacaaaataacgcacaacttccaaaatcttgatttcaagtttccctttatctgctgacctcctcctgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaaaaaaaaaaaaaatcctgtagatagtttaattgggatcatataaaagatatattttagggaaaatcaacatttttagctgattgagcctttctctttaagaaaaatatatgtttattccattttctatttattcaaggttttttttaatatccctgtggtataatatgaaatatatagttgtcattttgtatccatgggaattgttcccagaacccccttggatgccaaaatccttggatgctcaattacctttttttgtccttttcttgtagagatgggtgtctcacaatgttgccctggctggtcttgaactcctgggctcaagcgatcctctcaccttggcctccccaaagtgctgagattgcaggtgtgagccaccatgcctggcctcaaatcccttatataaaatcagatagtacttgcatataacctatgcacatcctcctgtatactttaaattacaagtaactctaggttacttgtaatacataatgcagtgcctactcatcacttcattcacatggattcaacttagtacttagcatggggcaaaatttaagttttgctttttggaactttgtggatttttttcttcaaatatttttggttctaggttggttgaatccagggctgtggaacccactgatactggtatggtatttggtatttggcctttgttttgtttctgtcacagctctttttttttttttttttagatagtctcactctgtcacccaggctggagggcagtggcttgatctcggctcactacagcctctgcctcccacactcaagcgattcttctgattcagcctcccaagtagttgggactacgggtgtgcactatcacaccgagctaatttttgtatttttttttctttttttgagacagagtcccactctgtagcccagactggagtgcaatggcgcgatctctgctcaccacaacctccgcctcccaggttcaagcaattctcctgtctcagcctaccgagtagctgggattacaggctcccaccaccatatctggctaatttttgtatttttagtagaggcagggtttcaccatgttggccaggctggtctcaaactcctgacctcaagtgatccgcccgcctcagcctcccaaagcgttgagattacaggcgtgagccaccgcacccttcctgcttcttctttcttaatacttatttatttctctttactgattgaatgcacccccaatataatgttacagtagccatccttgccttccactggcagtgcttatagtattttataattaaacgtggttgtaacttaaaaaaaagtcttttttagttcttctgtgaatcagctttgttccctttagagattcagtgagtcttctctgtctgcatccaaatgttggttcaaaccttgagcctcacaccctgcctgaggcacccttctctggtttgatgttgaactattgttcaacagtcaactttttggttgtgcttgtttatctggcaacaggtccttcgatcaggacatccagtttactgttgccattgatttcacaggcctatgagagataccctgtcaagggcccctaaaaacccagatactccatgcccttgccattcccctgatctagtgacccagctggataaatgaaaagacacaagggttgtgcaaatgagcagctaagtactgggagcttctccagctttctgagaaagaggagggtggccccagaaggctctgactgggtccaaccctgcagcatctccctgagatgctggcattccttgggccgatcccacagcagctgcagtggtgtgctggtgagagaagattgtgtggatttctttccagctttgtattcagcgacaacctgtttgtggtttgtaagcggccatcgtggaagtatttacacaacggcaagcactaggactcaggcccccccacctttctctgctggtgctccttggagaggcaccccgtggcggtgcagttttggggctgcagccttcttctttagagaaggggcaggtgccactgctctctgagggaagggccttgagagaatagcagctgacagttcttccctccctactttctcaagaaccccagtttctaactctacccttccctttggtgtctcctcaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaatgtttcttacttacaccccatcctgatttcttttcttgagaccagagagtgggaaagctctctcttgacctgaggatggatctgaaaattatgagccccttgaggacagggaatgttattcatctttgaattccgcagcatctagcaccaggtcttgtacagagcaggtgcccaataaatggttgaatgaatatatgaaaagtagaggcagagggctgggcacagtggctcacgcctgtaatcctagcactttgggaggctgaggtgggtggatcacttgaggtcaggagttcgagaccagcttggccaacatggctaaacctcatctctattaaaaatacaaaaattagctgggctggtgcctgtaatcccagctactcaggaggctgaggcaggagaatcacttgaacccaggaggaggagtttgcagtgagccgagatcgcaccattgcactccagcctgggcgataggagcaaaactccatctcaaaaacaaaaaacaaaacaaaacaaaaagaaaaaagaaaagtaggggcagagatgtggggcaggagaggtgactcgggctcagctgcatggtcctgctctgcttcttttttcttggagtttgtccgttggatgacaatgatagtggtgaacaggtatggagggcttactaagtaccaggtgcagtgctaaacattttgcctgtattgtcttagttaattctcacagtcctttgaggaaggcactatttttaactcctgtattaaagatcaggacacagatcttagttaaagtcataaagacaagaataggtggatttcagagctctgattaaccaggatcctctctggctgggtgctcaggaacactagggcctcctccccttaccctctggagcagtggggaagccagaaggaggggcccgannnnnnnnnnnnnnnnnnnnccagaaggaggggcccgatgttctgctcaaggaccgtggggtgagggtgtggtggtgccaccggaggcagaacttgccttgccttcctggcttgaggggcatatggtgtacacggccaccaccagagtgagcaggggcgggcatctcggtgaccagcctcccagggctgtcactgcctcactggcaggcatccatgcagggcagctatgagtcccagaggaacctttaggctgagggagctccctgaccctccgttagagagccccagactgagacctcagagagactcccagactgggaatccaaagggccattggcagagacattcaagaggggctcctgcactgaagggctcccttaccgtgagaagccctgtgaggaaccccctagcctgagcctcctcctgaggaacccaggctaagtcactctcagaggaacccacaggctgagagaccctcagagggacctgcaggttgaagcccttcagaggaactctcagaatgagacattgttggaaggtcctctccattgagacacacagggccccaggttgagaaggtgacatgaggagggatgtagtggggtgtgctctgatctcagcgtttaggaaaggatcctgggaactttggctctgggccgcaccccatccttgccctgactcatgcctactgctctgcccttcttcctaccccctcccagtgacttcaggttctaggtgtctgggcctgggcaggtgaggagggccactggggttgggctctctgggatgtcattctgggtcctggatgggggggtgttgctctgcagctgggttagggaaggcatggggctctgagggagggagagagaaacacgtggcccgaccagtttggagttggtgttagctgccaagcagctcaagtgggccttgcatttgtgcactctgggccgctgaggggagctgaagggaggtcaggcaaacactcactcaatctgcctccctccatcaggctgcccttctctggcttcctcctgatccaagttctctacattcatctctctgcctccaggactggtaaaggctggg

SEQ ID NO: 14448 - DNA, 5377 bp, Human
accacataggcatggttcaaagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaagagggaatcctccctaactcattttatgaggccagcatcatcctgataccaaagccgggcagagacacaaccaaaaaggagaattttagaccaatatccttggtgaacattgatgcaaaaatcctcaataaaatactggcaaaccgaatccagcagcacatgaaaaggcttatccaccacgatcaagtgggcttaatccctgggatgcaaggctggttcaatataagcaaatcaataaatgtaatccagcatataaacagaaccaaagacaaaaaccatatgattatctcaatagatgcagaaaagacctttgacaaaattcaacaaccttcatgctaaaaactctcaataaattaggtattgatgggacgtatctcaaaataataagagctatctctgacaaacccacagccaatatcatagtgaatgggcaaaaactggaagcattccctttgaaaactggcacaagacagggatgccctctctcaccactcctattcaacagagtgttggaagttctggctagggcaattaggcaggagaaggaaataaagggtattcagttaggaaaagaggaagtcaaattgtcccggtttgcagatgacatgattgtatatctagaaaaccccattgtctcaggcatggttcaataaataggttttaggtgactccttgtggtttttgttcacttctctcctttctttaatttggcgattaagagtacattttttaattccttaaaaggtctgtagtacacatctttgagggcagcaaggaggaaaaacaccgaggggacttgattccactgtggaatctgtcctagcagagaaatgcctctatggattgggtggaaaagacagctctaaaaacacaaagaatataggtcaaacccaggattatataggaaaaaaaaaagagaggaaaaaatttcaggcttgaagaagagtctacaaatagcacaatgtggacagtctccaacccagagccaggtattattctctcctgtgaacacagaaagactcaaacccagggaggagaagtgacctacctgtgatcacaggacttgccaatgatagaactatgttcagtttctcattacttctagcaaattggcaaattatactaagggagtagaggtagagttgagttcatgtacaacaatatagaaatcagctaaagtggatcagagcaggaagttttacaattcagggaaaggttaagatagaaagggatcctttcccccaatcaagaaagacagccttggaccaccagttagagaatcccccaattttctctctgccataagtcactgaaactgagagctaaggcagggcctctgtgagtcatgagcacttaatccagcgggagacctcagaacaggatatttccttttttgagattccctgtcataccagttatggataaatttgcattttggatgggacattactggaccagcccattttaggcagttccgtttccccctgggtggggcagcaggccctgtgaagaggttctcagcctcatgactcctaaactcctggtacttgagcaccgatctgcttcggagaacctggtgagtctgcttacttgaatttctctgttctttgggccctcaaaagttgaatttaatctgaagacagaaagtatggttgatccaaacctctgatgacagttttgacactacttagtggatggaaccttaggattagatcataatgacacattgttttagcttttttttgtaagtagcttggtgttcatatgaacagcgaagttaataggaaggctttgatttgaggaagaggtaaaagcaaagtgtttttccttttttctatatctttctggtgtccttttcaaacatttgtgttttagcaggtgtgagagcctgcaattcttcccaaacagccctttgctctttgcccatcagcccactggggctttacaacagataatgatgataggaatagcttctgagattgcccagagtatctgaacttgtgactgcctttcatgaagtggttattttcatgcttgattctttataacagagatattttctttagaaaaattgcatgagaaaacacaggatttcccagggttgataaagcaatttgctaaagtggaaaggagaaaccagagagtcatgaaaagggaattaggagtttaaataattttttggagactggagaaatagcccatggtattacataaacgttggcttttctttgtaggagtcccttcctgtgaaccctgttatataatttctttcagattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaacagcttcggaattcatcaggaccacgaaaggatagggataattggctcacctcgttccacagctccacctgcatcttctcatcaaagccatccagggatacacagggagcttctttccccttagcctgtgatctgcccatgatgatccccgacagcaaaatgtttcctttctgaggctgccatgctgccactgtccaggtggagactgagcaaaggaagtcctcagctgtaccggcctttcagagcttctctttgggtgccatcaaagaattattttgatgtcttctgtctctgtctgtcacctggcatgagcttctactatctgtgcaattgtcacttttctttcactccctgaataaagtagctatgcctatatttttgtgaatggatatttcatttctgtttaaacctactttattaacaatatcatatgatcatttggatttatttctatctttcgttggtccccaggaccaggctctcatgattattgtaggaattttgggtcatactaaagattatttctgtgtgattttaaacccgttttattttccttagttagtgttttgattgattcaaggaacatattattcaacttccccaaatgtcagtctctttactgcaaagtgagcaaaataacatttacataacaaagctagtctaaggcataaaattgaattactatctgaaatttggttggcagaatgcttgacacataattagcagtcatttaattgaggtttattagcaggaatatatcatccttgtcttcatcatcatcatcattatcatcatcaccagcatcactacaccactacaaccaccaccatagttgctccagcaagagagtagcttggatataactaatacaggaaataagaagagtctctattgctattttttaagaattcataatacttgtatacaattacggggtacatatgatatcttgttacatgaatagaatgtgtaatgatcaagtcaggatatcaggaaatttagactatccatcgcctggggtatttatcatttttctttgttaggaacattttaatttttctctcctagctattgtgaaatatagaatacattgttgtaaactagtcaccctactctactgttgaatattaaaacttattccttgtatctttttgtttgtacccattaaccaacatcccccccatcccccacaaatacctttccctgcctcaggtatcttatcattctattctccatgatatctatctccatgatattgacttttctagctttatatgagtgagaacatgagatgtttgccttcctgtgcttgacttatttcacttaagataatgacctccagtttcatctatgttgttgcaaacgacatgatttcattcttttttgcaaccaagtagtatttcattgtatatatatactatattttctttttccattcattcgttgatggacacttaggttgatgggcacttaggttgattacacatctttgctattgtgaatagtgctgaaataaccatggaagttcaggcatccctttgatatactgatttattttcctttgtatacacacacagtagttagattgctgaattgaatggtagttctatttttagtattttttgtgaaattgctattattacctgtgcttttgaagtcttacccgaaaaccccttgcatactcttacatcatagagtatgtttcctgtgtgttcttctagtagttctatagtttcaggtcttacatttaagtctttaatccatattgagttggctcttgtatatgatgagagatataagcccatgtttcattcttctgcgtatgaattccatttttttctgaacaatttattgataaatttgtcctttccccaatgtatattcttggcatctttgtcaaattcagttggttgtaaatatggaggtttatttttgggttctttattgttttcctttggtttatgtatctgcttttatataatagcatgttattttgttgaccatagccttgtaacatattttgaagtcaggtagtgtgatgcctccagctttgctctttttgctcaggattgctctggctattcagggtgttttttggttccaaatgaattttagaattttttttttctatttctgtgaagaatgacactggtattttgatatggattcatttaatctgtagattgctttgggcagtatggtcattttaacaatagtagttcttctgcttcatgagtatggaatatctttcaatttgttttagtgttctttaattttttttatcagtgttttgtagttttccttctaaaacttttcatctccttagttaaatttattcttgggtattcttcttttttgtaggtgttgtaaatgg

SEQ ID NO: 14449 - DNA, 34088 bp, Human
gtgacagtggtggtggcaatggaagtagcagccaggcaggtacctggaactctgagaaaggggaacctttgtctctgatcagaggaaccatgatcctaaaagcatggggggaataattttcacatttgtgtttctctctctctctctctctctctctctctcacacacacacacacacacacacacacacacacacacacacacattgctttggtcctgaagatagacccagtcagaagagatgcacagcagagaaggaaaatgaaaaccctggtctttagccagaagaccaaggcatatcttcatttcttaatatactaattgcttcagaaggtggaaatggctcagggcctctcagcttaagagactaaggggttatgggttgtattattttctccatttcatagatatgagcctaagaaggttgtttttcttcttacttaaacttttcctactatgccatgttgtccatgggcaagtcaaaggtatcctacagcctgtaagagtggcacagtgcttatttgcaacctttaagagaggtggcaagatgtgggattcatggagaaatctctcctttgcttggattaatcctgtaaacaaggtggtgtaggtgagactggggttggcaggtgggattagggtctcccttacttcctagtttccgtagcctgggaaaaagggatgatcagtctggtttgagatccactggggggttcattgcctttctttgcaatgcctttggtcttagcttcatttgtccaaactcctctctcccttggctctccccagaccaggcaaaggccaagctggctggtctccccacctgtggccctgagggcaggacctggcattcaccgtttctgctaatgagatcaagacatggcctcttctaattactccagccctcacacaatcttccccacatgctctccacaccagggagcagcagggggcaggaagaagggaccctaacctggagcatcctgagcagactgtttcagggcgggtcgggaaaatgaaggttcgccaattcaaaggtggaggggaaaatggttcagcctttgggacttgtatttggtgtgaaaggagttgcttgcctctgggtcacagccctgcattcagctccctgacttgcctaggagtcaggaagaaacttcttggtctcaagcccagttaggggcaaggcactggctggaaggaaggccagggaaggaaggaggttgtccactagaggcagcagccagccagcccagcccttctctggtgcctgccggtgtggtcctctcccagagactggggggccttcatctgccccatgaggaaaagaggagtggaggaccatggaaagggatccagaaaaagaaggaaacaccaagtcccaggggcatgagctggaagggagggctgctcctcccaggggaggctggggactgagagctgtccccaagagtggaaaaggagggagctgggcaagacccagcattgttagtaaccagctctgtggtcttgacttgacctcactgattctcagtctcctcacttggaaaagggcaaaacagccacgtgcaggccgtggtgggcacccgggctgtctgcagatagcttggctcattgttggtcctcagtacgcagccctcgtagccaagcagcttgggcctacactctgggcccaggggagtggctgtcgctggcatcccctggaataacatgctccgggggtcaaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagcatggcctcgcccgacccgcccgccaccagctacgccccgtccgacgtgccctcgggggtcgcgctgttcctcaccatccctttcgccttcttcctgcccgagctggtgagtgcggcacccccgacccgggccacctgcagagagggagggggagaccggcctcggacccagaccggaccgagaagagagagacccagaccggaccgagaagagagaggggcagcaagcacaggggccacctgcagagagggggggggagaccggcctcggacccagaccggaccgcgccgagagagacccagaccggaccgagagcggggagcgagcacaggggctgcggtggctgccagcctcccaccgggcgcacagcggggcgcagctgtactcaagaggcagatgccactcggtgccccgtcttatgccgccaagggggttcctccctccaaaacaaaacccacttgagtgtggaggcctggggggacgtcgctaaaatatccaggcttcccagggagatgttgcacatgaattttaattacgcggcttcttttgtccaactatttgtgcctttctggtttgaagtgaggagactgtgtttccctctgagagtaggtcttccagtgttttcttaattgtcacgtccgctgactttgaactttgacttttgtggggtctcccacaccaggtagctatggcaacatctgccataaaacagtcgtgtgcggcaccctggttgcaaatgagaacctgtcgctgtgttactctctggggcgccctacgactgagtcgtggccctgatccctggggatcctgcctgctcccatctgcagagctgtgcgtatgcagcgttccgcactgcacaagttccctcggaactggctggtaccacatcctcttcacggaggagcacagtcaagcctggggtccaatcaaggcaaaggagtgttttctttttccagcaccttctgaagtatctagcttgtgggtggtattttcttacctgccctgaatttggcagtgctgtccctgagcaggggggaaaagatagaaagtgcatctacttttcagcccttctcattctcgtcttctgcttgcaaagttgggccccctcaagccacttttaggcaaactggcgaacgggttagccattgatggcgaccagaaagagaatcaggcagggtgggcctaggatctgagtggctccagctgaaaccccacctaagaggcaggtttctgccaaggctaccatccccagcacagcgtgggcatcctgccagactgatgacataaccgtgctctgatgagtcctacgtgccaggccctgggtgtgcccctcaccttggagcagctgcatgggtggctggggtactggttgactctgcctctttttattgagcctgtggttcatgtcagtcctgcaagcccctggtgacagggcactgcctcctggtggtttcctgtctgccgggaagagactcatgagcatttcctcccaacaagtggatggtggcctcagcaaggagggaccatctgaactctccaggccaaggaggggtccaggcctgccaccaagagttggacctcaaagaacaggcatttacaggctggggggaaagagagggaaaggcctagaggccaggggagaagtcctggaaggaggctagaggcacggagtttctggaaccaggacagcacccagggtgagaaacatgagaggtcatgttggccgcacctgccctgctcctgccagtgaaactcctggaagagcaaagtgcacgctggtgttgggctctggggccttacgtgttgtggggggtgaggggctcaatgacaatcaaaattcacattggcccaattttcttcatttatttgtactgttaagtaacgtgagatttacagtaaagctgcaataatagtagagaaagttctgtgtactcttccctcagctgctggtaatgcctgcatcttccgtggtacaactcttgaaatcaggaaactaacactgatactgtgctatcaagtactctataaaccttactccagttttgctaattttctcactaatgtcctttttctggtccaggatcccacatggcacttagttgccgtatctccttcatctcctttaatttgggaaaatctgggtccttatcttgacacttctgaagagtactgattaggtttttttctttttttgtgcttttgaaaaatttatttttccataaattattggggtacaggtggtatttggttacattagtaagttctttagtggtgatttgtaagattttggtgcactcatcatccatgtatacactgcactacatttgtagtctttttttttttttttttttttttttgagacagagtctcgctgtcgtccaggctggagtgcagtggcgcgatcttggctcactgcaagctccacctcccgggttcatgccattctcctgcctcagcctcccgagtagctgggactacaggtgcccccaccatgcccagctaattttttttttgtatttttagtagagacggggtttcactgtgttagccaggatggtctaactcctgacctcgtgatccgcctgcctcggcctcccaaagtgctgagattacaggcgtgagccaccgtgcctggcccatatttgtagtcttttatccctcactcctctcccactcttctccccaagtccccaaagtccactgtatcattcttatgcctttgtgtccttatagcttagctcccacatatcagtgagaacatacgatgtttggttttccattcctgagttacttcacttagaatcatagtctccgagctcatccaggtcagtgcgaatgctgttaattcattcctttttgtggctgcatagtattccatcatatatatgtatatatttatatatatacatatatatatatatcacagtttctttatctacccattgattgatgggcatttgagttggttacacaatttcacaattgtgaattgtgctgctataaacatgtgtgtgcaagtatcttttttgaataatgacttcttttcctctggattgatactgagtagtgtgattgctggatcaaatggtagttctacttttagttctttaaggaaactccacactgttttccatagtggatgtactagtttacattcccaccagaagggtagaagtgtttcctgttcaccacatccacaccaacatctattttttttttgattttttgattatggccattcttgcaggagtaaggtggtttcacaatgtggttttaatttccatttccctgatcattagtgatgttgagcattttttcatgtttgttggccatttgtatatcttcttttgagaattgtctattcatgtccttggcccactttttgatgggattgtttgtttttttcttactgatttgtttgacttccttgtagattctgaatattagacctttgtcagatgtacagattgcgaagattttctcccactctgtgggttatctgtttactctgctgtctgttccttttgctgtgcaaaagctctgtagtttaattaggtcccagctatttatctttgctttcattgcatttgctcttgggttcttggtcatgaaatccttgcctaagccaatgtctagaagggttttgccaatgttatcttctagaatttttgtaatttcaggtcttaagtttaagtccttaatccatcttgagttggtttttgtataaggtgagagatgaggatccagtttcaatcccctacatgtgggtagccaattatcccagcaccatttattcaaaaggatgtcctttccccacattatgtttttgtttgctttgtcaaagatcagttggctgtaagtatttgggtttatttctgggttctctattctgttccgttggtctatgtgcctatttttataccagtatcatgctgttttggtgactatggccttatagtatagtttgaaatcaggtagtgtgatgcctccagatttgttctttttgcttagtcttgctttggttatgtgggctcttttttgttccatatgaattttagaatttttttttctaattctgtgaagaatgatggtggtattctgatggggattgcattgaatttgtagattgcttttggcaatatggttattttcacaacattgattctacccatccatgagcatgagatgtgtttccgtttgtttgtgtcatctgtgatttctttcagcagtgttttatagttttccttgtagaggtctttcaactcctttgttatgtatattcctaagtattttattattactattattattttttgcagctatcatgaaaggggttgagctcttgatttgattctctgcttggtcgctgttggtgtatagaaaagctactgatttgtgtacattaatcttgtatccagaaacttttgctgaattcttttatcagttctaggagctttctggaagagtccttagagttttcaagttaaacgatcatatcgtcagcaaacagtgacagtttgacttcctctttactgatttggatgccctttatttctttctcttgtctgattgctctggctaggacttccagtactatggtgaagaggagtggtgagagtgggcatccttgtcttgtttcagttctcagagggaatgctttcaacttttcgccattcagtattacgttggctgtgggtttgtcatagatggcttttattacattaagatatgtcccttgtatgccgattttgctgagagttttgacaataaagcaatgctggattttttcaaatgttttttctgcatctattgaaatgatcatgtgatttttgttttaaattctgtttatgtggtgtatcacatttattgacttgcatatgttaaaccatccttgcatctctggtatgaaactcacttgatcatggtgggttatctttttgatacattgttggattcagttagctagtattttgttaaggattttagcatctatgttcatcaaagacatcagtctgtagttttcttttttggttacgtcctttcctggttttgatattagggtgatgctggcttcatagaatgaattagggagggttccttcattctctatcttgtggaataatgtcaaaaggattggtaccaattcttctttgaatgtctggtagaattctggtgcgaatccatccgttcttggactttttttgttggtaatttttaaattaccatttcaatcttgcagcttgttattgatctgtttagtgtatctaattcttcctgatttaagctaggagggttgtatttttccaggaatttatccttctcctctaggttttctagtttatgtgtgtaaaggtgttcctagcagccttgaatgatcttttgtattttggtggtgtcagttgtaatatctcctgtttcgtttcttagtgaggttatttggattttctctcttctttccttggttaatcttgctaatggtctattaattttatttatcttttcaaagaaacagctttttatttcatttatctttcatgggtttttttggtttcaatttcatttagttctgctctgatcttggttatttcctttcttctgcgggttaggatttggtttgttcttgattctctagttccttgaggtgtgaccttagattttctgtttgtgctctttcagactttttgatgtaggtgtttagggctatgaactttcctcttaacactgcctttgctatataccagaggttttgataagttgtgtcattattgtcattcagtttgaagaatttttaaatttccttcttgattttgtttttgactcaatgctttcagaagcaggttatttaatttccatgtatttgaatggttttgaagattccttttggagttgatttccagttttattctactgtggtctgacagagtgcttgatataatttcaattttcttaaatttatcaagtctcattttatggtctagcatatggtctatcttagagaaagttccatgtgctgttgtatagaatgtgtattctgcagttgttggatgaaatgttctgtcagttgtaatatctcctgtttcatttctgttaagtccgtttgttccaaggtagtttaaatccattgtttcttcattgactttctgtcatgatggcctgtctagtgctgtcagtggagtattgaagtcccccactattattgtgttgctttctatctcatttcttaggtctattagtaattgttttataaatttgggacctccagtgttagcagcatgtatgtttaggattgtgaaatttttctgtcggacaaggccttttaccgttatatactgtccctctttgtctcttttaactgataatgctttaaagtttgttttatctgatataagaatagctacccctgcttgcttttggtgtccatttgcatgaagtacctttttccacccttttactttaagtttatttgagtccttatgtgttaggtgagtctcctgaaggcagcagagggttggtgagttcttatccattctgtggttttgtgtcttttaagtggatcatttaggccatttacattcaatgttagtattggaatgtgaggtaccattgcattcatcatgctctttgttgcctgtctactttggttatgtttttgctttttaatttgtatttttgttttataggtcctttgtgatttatgctttaaagaggttctgttttgatgtgtttccaggatttgtttcaagatttagagcttcttttagcagttgttgtagtggtgttttggtaatggcaaattctctcagcatttgtttgtctgaaaacgactatatccttcctccatatatgatgcttagttttgctagatatgaaattcttggctgataattgttttgtttgaggaggctgaagataggtccgcagtctcttctaggttgtagggtttctgctgagaaatctgctgctaatctgatagcttttcctttatagattacctggtgcttttgtctcacagctcttaagagccttttcttcgtcttaactttggataacctgatgacaatgtgcctaggcaaagatctttttgtgatgaatttcccaggtgttctttgtgcttcttatatttggctgtctaggtctctcacaaggtcaggaaagttttccttgatcattcctccaaatatgttttccaggcttttagaattctcttcttcctcaggtacgccagttattcttaggcttggtcgtttaacataaacccagacttcttggaggctttgctcatattttctttttttttttctttgtctttgttggattgggttaataattcaaagaccttgtctttgagctctgaatttctttcttccacttgttaaattcaattgctgagatttcccagagtatttcacatttctaaaagtgtgtccaaagtttcctgaatttttgactgttttttctttaagctatctatttccatgaatatttctcccttcacttcttgtatcattttttggacttcctttgcattgggcttcacatttttctggtccctccctgattagcttaataactaatctcttgaattctttttcaggtgaatcagggatttcttcttggtttggatccattactggtgaactagtgtgattttggggggtattgaagatccttgtttcgtcatattaccagggctggttttctggttccttctcatttgcataggctctgtcagagtgaaggtctagggctgaaggctgttcagattcttttgtcctacagggtgttcccctgatgtagtattcttccccttttcctatggatgtggcttcctgtgagccaaactgcagtgattgttgtctctcttctggatctagccacccagcgaatttacctggctctgggctggtactctggattgtctgcacagagtactgtcatgtggaatgtctatgggtctctcagccatggatatcagtgcctgttctggtggaggtggcagagggtgcagtggactctgtgagggtctttagctttggtggtttaatggtctatttttgtgctggttggccccctgccaggaggtgacactttccaaaaagcagcagctgtagtagtatggagagggaccagtgttgggtggagccctagaactcccaagattatatgccctttgtcttccaccagagtggatagggaaggaccatcagataggggcagggctaggcatgtatgagctcagactctccttgggtgggtcttgctgttgctgctgtgaggggtaaaggtgagattcccaagttactggagttgtgcacttaggaagattatggctgcttctgctgggtcatgcaggttgtcagggaagtgggggaaagctggcagttacaggcctcacccagctcccacacaaaccaaatggccagtctcactccctctgtgtaccccccagcagccccaagtctgtttctaggtggagggcaagatgggtttgaaaacttgccccaggctatcctcctccccagcttcccccggtggctgcatctttcctaacagtagtacagtatcagagcccagaagctgcccttggtacttgggggctccacttttctcacatgtgtagattcagggaatcaccactgcatcaaggcacaggactgccactcaccacaaagagctccctcgtgctaccctttcagggtgcaccccctaccctgccctccctcaccccctcctgaacaaacccctgaaaaccacaaatttcattcctacaattttgttatttccagaaagttatataaatacatgaaatcacacagtatatgggtctttgaggttggcttcttccactcagcctaatgctcttgagcaccatccaagctgtggcctatgtcaatagctccttccttcttactgctaagtagcgttccgtggtctggctttgccgtcatttgtttaaccatccacctattgagaaacagtttgcctgtttccagttcttggccgttccaaataaagctgctgtgaaaacttgtgtgcaggcttttgtgtgggggtaatgctcagttctccagggaaaatgcccccgtatgattgctgggtggtgtagtaagtgtacgctttattaagaaactgacaaactattttccagagtggctggagaataacttctgtgttttacatccccactagtgattgatgaaactttatcagtaaagttcatgttttatgtagtttactggtgaatttagatttcttatttaaagacaatattaattttgaaacataatctccaagtgcaaaaaaggtttgaatgggtgaattttaagatgagaacagacatccatttattttctctctccttcatgtagcaagtgtgtgtgcctcgggggagcctggggtgggtgcggctcacacccgtgccctgctctggagccagctgtctgcgggtgctgggggctgaccatgccattacctgtatgatacgaggtgactcatcagcttttttataagctgaattttataagccgaagggtggaagctgcaagctcacccagggtgactgtgaacaaggaaatgctttatgactatgactccaataaattattttaactgtcaaccttgtcactagttgacttatgagatttttgactagtttaaaacaaacagctaagatttctagaggttcagaaagttaaaagcggagaccatgcaaactctttgtttgatgttagatgttttcctttcagctgcttaactcaccagcacattagtcagagataaatcctctgagcccttagaagttcatcctgagctcttccagttcggcaagttcattgtatgtcttacccaaatggccagtaccaccttcattccaacctgctgctgcttctactctgtttatatggaagagcctgtctgaagctcactgaagccaggggcttcccgggagccccctagggccaactctctgtggactgaaagtgaatgggtggggctgggagaagaaattagggctcctcttaggcctgaccttaaggcaggcatcttccccttccttccaactgtgccttagaagttgagttttccaggaggagaaatcatctcccttgctttcctctgctcccctgtcagttctccatacttccaggagcagcaaagttaactcaatttaccccagtttattttataattttcttttcatgcttcagcctttctgtctctgtccctcccttcactcccctcactgccatgtggcgtcttcctgtccttggtctagctcccacagggcagcacccttctcttctgttctcctgcaggacatgggagccaccaacctctgtgcccgtgggaccatggggtcccgttggaataatggccaaggatgtcccctggaaaacaaggacgggagaacatgaggaaagggaaggccttgggctggggaagagcaagacctcccaggagagaagatgaaaagggccatgggacaggagttggatgtgaacctccccacactgcctgtggccaccttggccccttggccaggcccagcccctactctgggagggcactgtgtattcaggttcagtaaaatagagtcagtcaggatggggcctaaagtctggctctgcttcttcattgctgtgagaccctgggcaggttacttcatcactctcagccgcagtttcatcaacaatggaaagagtaacaataaagagaaacaaggatcctataagacagctgtggggtttgaatgtggacttcataggaaatgtcaggacatggtgagtgagtgctccataatgccagcccatactactttagcattggcggtcattggacctcttactagaaagcgcattgtaagacaagtaacaattgtaagtcaacaagtgtttattgaaacactactgccactctagccccatgctctgctcttaggggcatacaaaaataagacagtcattgaggggataaggtaaggcatgagcctctcttaaaggagtggtgcaactaacacactgaagatgcaacgagcactccaggacaggagacaggtgaaaagcaggggctgcacagccacagctgcccagaggccctgggagccaggtggtgtcaggacaagatgattcaaggaggagcttgacattcttggagggcttggattgatgggtgacgcattttcttgttcagattaggactgcctaggaccaggaagttaacaaatatataaagtcagggtacataaagacttaagtctcccacttaaattccaagtattcattcaagctgagcacctactctctctctgccaagcactggcgatacaaaataaacaagacagacatggcccctgcctatggagcctgatgcgtaatgagggcggtggagaacagccaaggaaatctgtaaaggcgctgtgcctgtcacggtccagtaggaaacagaaaccatgataggtgcttcacacagaggggattcaatacaaggacttgttgacacagtcgttggaaggctcgatgaacagaaaggggtcactgaacaatccagagaataataagtgctcacagtgcctgctgcccaaccccagaatcagggacagaggggcagcgatgctgatgctcaaacctatagatgaagctgtctctgtcttgccagtgctcagaccagtgtgggggtgctgggagacagtggtcaccctaaagaaagggcactgggaccctcatctccagctgctgctgctgattctggagagacaatggcaaggcctggaaaaggcagcaggaagcccccacttctctcctaacatcccagcctccctccaagtcctcccctgccagaacctagcaaggaatcagccaccgagggagcccacaccacacagcagagagatgctgggaaccacctggcctggccctgcatccctggccactccggcccctgtctgaacttccagccctggtctttccctggccgtccagcaggaccatgagcagccgtccctgaaccagtggcctctctcaactcggccaagacaaacaaccaagcacactttcagaaggccagcccacccagaggggtccacagacttgacggctgccctgaaggagccaccggctgctgacatggagcctaacagagaggccctgggcagtctgacccactggacccagggcgagccccagataaggagccttgccagtagaagtgctggctgtctctgccattcccaggagctgtctccctggagaactttcccctgggcagggcagatgtgtgggagtcaggagaggctcctagagcgttgtccagattggcaacactcagggcaaagggccctagtgcggaggagctcaaggaccctggcctttgccccctcatctctttccagcccctcccctgcctcatccatccctgccagccagcccctagcctcgggccccctttgcctcctgaagagaccagcctgtccctcagtcaccacctagtcaggctcccccatctcagccagaatggatggctgctcaggccccacacaggccccactccattggacagggccagcccttgtaccacgttccacagcactagctccccatggcaccacttcctgtcccctggccacaaactgtccctagaagataccagcggggtcccagagtacagtctcagtgggatccccatccagaggggccggatatcatgagtctgggactccagagtcttcagacctctttcaaagaagactggattctttgagctttgcttttctacttcagcactattcacagatacccccaccagcctccctccaacactgcccatctggactctttctgccccagtgatgttgggggaggtatggagggggatgtgtatttatttgagcactgtcctttctgacagcacattttttagtagtctgtcctatgtaccagggtggtggggcatctcaggatgacaaggggtgccgatggggtcagggaggaggcagggtggtgggaaaagccttcccagggaatcctgagggacagttgctccctaccctactgggagaatttctggggcctgggaggtgatggagcaggaaataggtgaggatgaaacaaatacacgtctgtctccatttggttcaggctcctggcaggaatgccggtctgtggctaggccacagtggaaggcccagaaggcggcaggcgatgccacttccatgggcgtctgtcccaggaatctgaggctgtgagcagctagtgagtggtgtgtccagcaaccccctcctcctttctcaagtgagtcagtgacatgtaccaagcacttgctttatgccaggctccatgctgtactccagggacagagacctcagggcacacagtcctgcctccaggagctcagagtttcaacaggaggcagggaagagaaaagagagaatgacagtggagagtgatcctaggggaggtatgctgggggacttggtagtcaagggtggcttcctggaggaggtgacatggtctggtccctgcctttcagggtctagtcatagatagactggggatcagctggggagagccaagcaggcaatccatcaaccagaactaagtgacccggtgcctaatgaagggcaggttattagtcacaaaatgtctgtgggctcctgaggagaaaggagggtatggggacttcccctgagcctgagtccagggatcatcagccaacttcttttggggaacatgggcaggaacatgaagttaatcaatgtacagggagagtgagaaagaggacactggggcagggggccagggagagtggggaagcccagccaccgggccgcggtgggagcaggatgccttccccttgctgctttacagcatttctgtgcttttctaaggtacacaggtagtcaaaagggaaaatatgccccccaaatgctgtgtttaattttgtcctcttcctttttttttaagagacaagaaggaaaagggctttagactttggatggaaaagaatgttctcattagtcaattttatgtgacattgcaaatctgtgctgtttggtcagtaaaaagtgaaggcaatcagtctgaatgggcggacgtggtgctgggggaggaggaagcaggaatggggatgcctggccctgactcagggcccctcccagactgcacttcctgccactctggtgcgcccatcccagggaggccgggcgcactgccagccccattcagtgagtgcttatgagtaccaaggacgcctgacttgctcagccaggagcagctgcggacgcgagttcccaccagtgctggatggaagttcctgccaacactgttatccagcgggagatgagacctggccctcactggaggccttaggggcctgggctggcaatttcctgctagccttaaagccacagaaaaagaaaattctccctccatgagtcaggacgcagtgactcagggtttggaagtgtgctaggttgaactgcagagtgtggaactttcatgcaatgctacttgttttcagggtgctcttggggtgctggagacagacctgccacacccctactgggtaactgaggatgcccctctgccttttagagccagcatcctcctgtattcgaagcacaaaggagataaggatggctgctcacaaggcttcatgaggctgcagggccagtgacacgcgggtgggagctgccttatgggctgtaagcagcacccaggtgggctctgggtctctgagccacccacagggagacttgcagtcaggtgagccctgcccaggagcacccagcacagcctggctgggtccctgacctccagctgtggcacttggggtaggagcatgcgtgtggaagaccctagctcggatacagggagttccagccccacagaggtagggcactccagggctcctcccactctccctgacagcgggcctgtcatctcaccacatttcccttcaccttcctcagcggctcccactcccacccagacccccgcatggcccctcaggccctgggatggggctcctgctgcagccgccaggctggggcctgtgctgggctgtggcctacccatgggacagtgctgtgaaggggaggaatggtccaggggtgggcaggaaggaaggcacgctggagcaagggcttccacaaactcatccacaaaaagggagagatttccatcgcaacctggtacactacaggcgggtgtgggtgtgtgtgtaagtgaaacaaaagatccaggaaacagtatttccctttcctgtacacaaaacgctcctaaactttacatcctagtctgcttaagttctttttttttaggggggggacagagtcttgctctgtcacccaggctggagtacagtggtacaagtatagttcactgcagcctcgaactcccgagcccaaaggatcctccccgcactcagccttccaagtagctaggactacaggtgtgatcacttaattttttgaaacgttttctagagacagtatctcattttgttgcctaggctggcctcaaatgcctagcctcaagcaatcctcccacctcagcttcccaaagtgctgggattacaggtgtgagccattatgccctgttggcttcagttcttaatgctggttgataatccactaaatggagtcacaatccatgaatgagtctcactcatagtttgccagtcccaggactgggggaagtggtggaggcttggggagcccggcataaaggtgagggtgggtgtcctgagtttggcctgggagtcaggtgaggcagtggagtgtttgaagagagggtgaggggtatgggcgacccgcacagacttgaatcccaggggctcctcagcagtgctgtgaaagggctgtcgctggctgggactggccttaacagaagggaaatgcactatctcgtgtcctgcgatctgggtcagcagctcggtcgtgtcatctgggatgcaggctcctttcctctttctcctcctccatttcatagctccaggttcaccactgcacagtaatggccagagcaagaaagggaccattgtgccctgtgcccccttctcaggcaccaggtagactttccctctgtctcgttgaccaggactaagtcaagtatgtatccctagtagggaatgtgatgagcctaatggcatgggcagtgacatccccttactggtgagatcccaggtggggagctcactccacagaaacagtttgtaatgagagaactctctctgcaacaaggtattcgctgcagcatcatttgtaacaggaaaaagctagaacactctacataccctgactagggcctaattgagtaaatgaggttttatcaacttgatggaagataattttgacactgaaaacacagtggaccctcataactcctggattctgtatttgcaaatccacctacttgctaagatgtatttgtaacccccaaattaatacacttggcactttcacagtcattgacatgctcagagcagctaaaaacttgagttgccaggcacgcacacacattcccagctgaggtcaagcaaggtgacgctctgccttcctgtttgagttctcgtgctgtaaggtgtccttttcgagatccccttagcgctccatgttcagaaccaaactcccactcattttgcatgaacagaaccaaactcccaagggatgctatggtggcaggaacatgcgcacaactgtttgacagagctgtgactcttgaggcattttgcatggcaactgcctgatggggtctgaagcacagccctagggtaggccttgtcttgtttttcattttttttttttgagacagggtctttctctgtcacccatgctgaagtgcagtggcacaatcaaggctgtctgcctcccgggctcaagtgatcctcccatctcagccccccgagtagctgagactacaggcatgtgccaccgtgtctggctaatgtttgtatttttttagagacagggttttgccatgttgcccaggctgcttttgaacacttgggctcgagtgatccccaccttggcctcccaaagtgctgggattacaggtgtgagccactgcacccagctgttttttccttttcaggagtgtgcatcaaagagctatttggacactcgtggtcatagcagcattattcacaatagccaaaaggtggaagtaacccaaatgcgtataagcaaatgagtggataaaccaactgtgacacacatatgcaatggaatattattcagccttgaaaaagaaggaaattctgacacatgctacaacacagatgaactttgaggacattatgctaagcgagaagggcagtcacaaaaggacaaatacggcatgattccattcatatcaggtacccagagtagacggaaagtagaatggtggttgccagggactgcggggagggaagagtggggagttgttgtttaatgggtacagagtttcagatctgcaagatggaaagcactctggagatggatggtggtgatgggtgcacaacagtgtgaatgaacatgaatgccactgaactgtacacttaaaaatggttaagatggtggattttgttatatgtatttaaccacaatttttaaaaagagagagaggtatctagtaggcaagagagcctggacttaaacagcatgcactctgcatacgtgaatgcgagggacaatcctttccttcatcctgaaatatcacaatggcagagggagccttcaggacatccaggttcccgccgtgggcaacgcccgcatgtgtcctttgcagagcccattcctgcctggcccgtggtgggaccaggagaccccggctcacctgtgtgctgatgacaagagccgcacccatcttgactggggtctttttctctcagcctgaagttttttaggctttatgaagcctgtggtcacctgagtgccagggaagagaaggagaggcaaagctgtcataaaaattaagagacgcagtaagaaaaggaatttggggttggcagtacgtgaaacctgccatgctgaagcaatgcccagctatgcagaaaaacctgccacagggtacccacccctggcactcctccctccttctcagctccttgtctgccccaccccaaacccacacctcccagccacagcccagagccctggccacacagacctgagaccatgcatctttttgacatatccttcacggttcccagggcatcattactcaggcagcgtctgtctcagaacctcagtgtgtgatcccggcccctgaagcagcccctctcccacccatgaggggcttccagctgctctgtgcaggtgagcagatccactctacccaaaggccatcctccttatctcttcccattcagaattctccgtgagactccagtgcccacgcgactttcttttctttttaaatttacatattatttgtttggggttagtttaaacgtgaacagggtcctacattcaaaactgtctccaagccaagaggttctgcttccccgagaccaaggcactgactggctgattgggtctcattctggaagtattctgttcacccacaacaaatgcacatatacacagacactcgcacatgcattttcttatttttctgcacaaatcatagcacactgggtacactggtctgtgcctttacaaattcttggagtttgttccattttgggatatagaattttctctctctttttttttttttttgttttgttttgtttttgaagattgcagagtgtttcactttgcagacataattgatttaactggtcccctctggataaaggggtcatttcctagcttttctgtaatcaacaggctgcaataaacaacttttatatttgtcattttgctcacatgcatcatttgtaggacaaattccatcaagtgaaattacagttgaacagtatgggcatttaatgttttgatcaatattgccaaaataatagagtcgttgatggcacagttatttaacctggaggtggcaatggacttcaactgggaggttgcagacggacactgggggtctgtgagtccccagattcgtaggcaaaaattgtgtgtgtgtgtgtgtgtgtgtgtgtgtgtgtaggtacatttttcttggtgaccaaagccatcatcaactcataagaagagtctgtgccctctaaatgttatctcacccacccagctgattgatctcccatctctcctttccaaaagtgaatttcccatcctttagagaggcctctcttggacattccctcctctgtatctttctcatggaatgtcccttcctgccctctgtgccgttccaaatggttatggctactacagccaacattcaccatgtgccagcagactcaccaaaccctcacaagggccagatgatagaggggccagtgagacccccacctcttctatttgatagataggcacacagaggcacagacaagctaaatgacctacccaccaggcagagctgggattcaaacccaggaggaaaggcgctgcatggtgcatggactggaggtgagagtagaagcagagagctggcctcaagctttctcagccctggccaccccacctggggaacaacgcagcctcccttacctgttcaagcagactctctggggcaggaccccagaccctggggctttcttgaagtccccaaaggcttctaggagtagcaggacttggagtgccgcccggagggtagtgctcaggtatgcgtatatttgagaagctctttgcccccacaccacgttttttgccggcttctctttcttttaaagcagttttcaaaataataagcatcctccaaaagtgaccaaataagtttttgttttaagtatcattttgaactcatggattttaccttagttgatgcattccaatccatcatagctgtaagaagctcaagcggtcccatctttgggcagcaggagtctgctgagtccttttgactggacctcaggagcctttggaaattttctcactatctggtgtggtaacatccaggctcaacctccctctccaaacctggtatcagccctttcttcctggacaccaatctgggtgtttttaccccagttcttatagtctagttcttttttttttctttttttaaatgatgacgcgattagatttattggttaaaaaaagttcacactagatcgttaaatttaaaatgcaggttataagatggtaatttgacaatatttttttttagttggaaattttattttattatattctagttcttaaccactttctaaacatgaaggagctcttcatgttctagagaagaataggttttaaaaacctattgttaagctccatctttccttaagacgtcctttcaagtttcagttcagcctcttggaaaatttgtatatgactgtgtgtgtttgcttataagaaaaggatctgccaaagttgtgcttgaaatctacttgctctaaatggctcgctgtaatcaaatatttctcaactttgagggccagccccaaccgttgaaaaatatctcccgctctgaggaaatacaaaaataaacattaaaatgggaaagcagtttaggccaccaggaaatttggaaagccaaatatgagctttaagaaaaagtaaaaacaaatactcaaagttttcacaactgtaaggaatccaacctagactacttgagacagaaatgagatcaggaactctactgggtttcaatccacctgcagcccttggctctggtccctcctcctgtttaggaggtagaggggtgtggaaataagaagtgagtgactttcttctgcagaacattgattctgcaacactgaagccattgcaggaaggttcccatgacgtttgagcagattcccaaatgctcagaggcccctggcctgttgtgaaaggtaggacaaggatccctaagctatagctggaacccagagagaggaggccgctgatgggctccctgagactccaggtgtgatgtccccatcaaggcctctaatgccccaggcagaccttggctgggactgtagcaggccaccctctggcatattctaggagcctctacctggccctgcccttggccttgaaacctggtttttagggcaagaaccacaactgtcctacaccatgtctgagtcccaccacgcactgcctgtgtgacctcaggccctaatcccctccggtacagtattacctcatggactgtggcaaagattaaatgtgcaaatgtaagtaacgtgcatatggctgtgtctggccagggaagcttctgatggcaagaggggcaccgggaccccactgcaggcactgactggcaagatggggctgaggttcccttgctgtccccatgcctggcacaggtgagctggcagtaagcagtggaaggtgtcgaatggtagttctctggtctttccaagggagttagaattgttgtgtggtctaaatgaggcagtctgagtgaatgcattttatcaactgtaaagtacctggtgaaccactaataaccagcattgtttgggtgctgttcatatgccagcatcttaatgcacttctcatggcttcttggcaagcgccttaaagctgaggcctggtacctttctgaagcatcagcagcccttgtcactgggattgacactcagcagcacagttgtgggggagccagaggacagcggcttccgttcctcaccaccccctccctaggacaagccggctttgactcattctccggcagtctcagaccagcctaggacttccaaaattcacttggatgttgattgttaaggaggaatttgctaccagaactggtgctttaagaggtggccacgctgctggagttgttttcccaccccataaagctatgattgtgctccttgctgaggagtctctgccttgtggtcaacttcctgttctcttctggcttctcatctcccttttcttttttctccttaaaagactgtgaatattccataaatccaaagacaactgccagacaacagcatgtggaaacctcagaagggaaagggtgacatatctatgtctatgtattggccagttgtaagataagaactgctggtcccagaaagctaaggatatagttcggaaagcagaactgaagttgtatatcttttggctgagctatacagaagggtgtgaaggcagggcacagtggctcttgcctgtaatctcagcactttgggaggccaagctaggaggattgcttgaggccaagggtttaagaccaacctgggcaacacagcaagaccctgtctctacaaaaaataaaataaaaattggccaggtgtggtagtatgtacctgtagtcctagctacttaggaggctgaggtgggaggatcatttgatctcaggagttggaggctgcagtgagccatgattgcacctctgcactccagcctgagtgacagagagagactctctcaagaaaaaaaaaagtgagtgaagttgtttggtctagaaagtttctaatacatcattcagaactgagctacctccacggacatgagcttccaatcaaaattcactaaacataagaggaaacaagtgaacaagaatagaagttaatggaagccacaaactgcagaatcaagctattaaggccaagtgaatggaattttcagatattaaaatgtagaatgaatactaagcaggagtaataaaaagatatccacatctcgacacatggtatcactgtttcacaaactgcagaatgccgaagacagagtgaagactaaatatagccaaataaggaagacagattcctacaaagcaagagttcaactgacagctgacctttcaatggcaacaatggaagccagaatacaacagaatattatggaaaaatatacaacacagtggaaacatatcttggaagtgcggagagaaaataattgtcaggggaaatttaaggacgttttctaataaatcaaacagactactaccctctgaccttcactaaagagactactaaaggttgcactccaggaagaaggaaaattatctcaggaggaaaatctggaatgcaagaatatcttcatgactcaaaatagagaagcatttctttattattattattattattattatactttaagttttagggtacatgtgcacaatgtgcatgtttgttacatatgtatacatgtgccatgttggtgtgcgtgagaagaatttcttaaacttgataaaaaacatagtcaatagaggaaaagattgacatattcaactgcattaaaattgcgggcttagttaatcaaaggaaaccagaaaatatgtgaatgctagcagaatatatttgcaatgtttatggcagtccatgaaatccacaccattagcaagaattcctatgaatcaataagaaaaagaaaaatcaattttaaaatatttaactgattaaaaaataaaaaactttacagaggaggaaatattaatggctaacaaatatataaaaataagctgtatctcattagtaaacaattacacagtgtcagtgagcaacagggaatgtcccacagcatggtgtgaggttagtggggtgaggggatgtggtccactgaggactccaggccctttttaaagagatagtcactactcatttcagcctactctggcctgagaaatgggtacactgtggccagaaccatggatttctaaagaaatgtcccaaatctggattttccatgtgaaatatcctgttttgaatattgggaacttattcagaattgtttaaaaagtgtatatgccaatactgcttgagccaaaagacacattcacaagctagatttggctgagagtccctctgttcatgacctctgcattaaccccttgaattttctaacaatcggacctgactttaccgtgactcagcggggccagccttccttccccattttcctcttggttccctcctaacttcacctgaacttgtaactagagacagaaaagagacaccctgcaaagggaaacatactccacactagctaatgaagccccttcttttatgcttttatcttccagatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggtaagaaccagcagcatggctcttcctgggtggacgttctgggttgggtgaggacaattggcctttctgggcagggagggatcctgggctaggctcctatggaaccaagactttttatcttaccatttttactaccacgctaaaatgaagacatttatctgcaagcgtaaataattcctggtattccccttcactggcttccctgttaggagaatacacaatgacctgtgatcaagcatattctgatgtgtttcccctaaattttcttcctggtaaaatccttggagcaacactgaagaaaaagctagtaggaaaaaaatcactccattctcaaggccctaacacaatccctgcgacagggtatttcttccatatcccacatgaattatatgcaaagtatatatacatatatacgtatatacatatgtatatatgtatatatatgtatatatatactttaattgtactctacaaataattttggatgtagatgctttcatttaatattacatcactaatttttatttatcacgtcatctcaaaaaaccatttaaaactgttccacactgaacaattgaagacatatttaaaagtacagaatattgtattataggccctcatgtagccataacccagattccagcattatcaagaccttaccacatttgtttcatctagcctttgtccccactaaggaattttaaagcaaacaccaaacatcatgccattctattccacacacttcagtatgtttccaaaaaaactccgcaaactttctcacattatcacatgtatacgaagtaaacaattcctcagcatacctaagacagtatacagtggtcccccatctccggaggataagtcccaagacccctaggggatgcctgaatcctcagagagtactgaactccgaatttgctatgcatgcacttcttttttcttcttcacaatttcacagatagacaattcattcttactgtagatcttaacaacctcagcatatttttttctttccttattaagctgaaaacttatactttttaacttaaagaaagcaccctatgacttctctttggcatatccaaattgccagcatcactactcttgcaatttggggccattatgaagtaaaataaggattctttgaatgcaagcactgcagtgccacaacagttgatctgatagcccagatgagtacaaagcgactaacatgggtggcacagacagtgtagacatgctagacaaatgtctgattcacatcccaggtggaacagggcgggacagtgcaagatttcatcattgtactcagaaaggcacacatttaattgttaatttctggaatttttcatttaatatttcagaccaagattgactttgcataactgaaatatactgatctttattagtctgccattgcttacgacatagatattacattaaaaacactgtgtattagtctattctcacattgctataaacaaccagagactgggtaaattataaagaaaagaggttgaattgactagttcctcatggttagggaggcctcaggaaacttacaatcatggtggaaggtgaaggctaagcaaggcatgccttgcatggcagcaggagagatgggggagggggaagtgccatacttttaaaccatcagatcccatgagaactcattcactatcatgagaacagcataggggaaactgcccccatgatccaatcacctcccaccaggtccctcccttgatacatgtggattacaataggagatgagatttgggtggggacaaagagccaaaccatatcattataccactggcccctcccaaatctcatccttctcacatttaaaaatacaatcatgccttctcaacagtcccccaaagtttcaacttattccagcattaacccaaaagtttaagtccaaagtctcatctaagacaagagaagtctcttctgcctatgagcctgtaaaatcaaaaagcaagttagttacttccaagacacaataagggtacaggcattgggtaaatgctcccattccaaatgggagaaattggtcaaaacaaaggggctacaggccccatgcaagtcctaaacccagctgggcagccattaaatgtcgacattccaaaatctcctttgacttcatgtctcagattcaagtcaccctgttacaaagggtgggcacccaagaccttgggcagctccacctctgtggctcttcacagtacagcccctgcagctgctttcacaaactggcattgagtgtctgtgctttttcaaggtgaccagtgcaaactgtcagtgaacctaccattctggggtctacaggacagctcttctcacagctgtactagccagtgtcacagtggggactctctgtggggggtctgaccccacatgtcccttctgcactgccctagtagaggttcttcataagggctccacccctgcagcagactctgcctgtacatccagtcatttccatacatcctctgaaatcatggcagaggttcctaaacctcaattcttgccttctgcatgcctgtaggtccaacaccatgtgtaagctgccaaggcttgaggcttacacactctgaagcaatggcccaagctgtaccttggcccccaactgctggagctggggcagccgggttgcagagtgctgtgttccaggactgtgcagagcaacagggccctgagcctggcccacaaaaccatttttccctcctaggtctctgagcctgtgatgggaggggctactgtgaagatctctgaaatgccctggagatatcgtcccctttgtcttggggaccctcattactcatgaaaatttctgcagctgacagcttgaatttctccccagaaaatatgtttttcttttctaacacatgatcaggctgcaaattttccaaacttttatgttctgcttcccttttaaacataagttccaattttggaccatctctttgtgaatgcatatgattgtacactttcaggaaaagtcaggtcacatcttgaatgcttcaatgcttagaaatttcttctgccagataccccaaatcatctcttttaagttcagagtgccacagatctctaggacaggggtaaaatgccaccagtctctttgctaaagcatagcaagagtgacctttattccagttcccaataagttcctcatctccctctgagaccacctcagcctggatttcattgtccatatcaccatcagcattttggtcagaatcattcaacaagtctctagaaagttccaaactttcctacatcttcctgtcttcttctgggtaccccaaactgttccaacctttgcccattatccagttccaaagttgcttccacattttcaggtatctttatagcagtgcctgactcctggtaccaattttctgtattagtctgttctcacactgctgtaaagaactacctgaggctgggtaatttataaggaaaagaggtttaattggctcacagttctgcatggctagggaggtctcaggaatcttacaatcatggtggaaggcgaaggggaagcaaggcacaccttacatggcagcaggagtgagagagggaagtgtcacacttttaaaccatcagatcttatgagaactccctcactatcacgagaacagcatggggaaactgcccccataatccagtcatctcccaccaggtccctcccccaacatgtggggattacaattcgagatgagatttgggcagggacacagagccaaaccaaatcacactgcaaaaaaaaaaaaaaaaaggcaggactctagggggctggcctgcctcatttgctcattctttactgctatgtagccagagaggaaaatgttcacctgattgatgtggccatgcgtggctctgctctgcatttccaggacagcctgtaccacgggaccactggcatcctgtacatgagcgctgccgtcctacaagtacatgccacgattgtttctgagaaactgctggacccaagaatttactacattaattcggcagcctcggtgagtgggctggccaaggacagcagtcttgcctggaggatgtttcgtgcaggaggcctaactttgcttgtgctgtatagaccctgagccctcaagtggaaggagccatgggggcaggggatagggatgtgtgtccctgtaaacatgtgcacccacgttcaggggtcctcttttaccttctattgttcccactccagctttcctctctcttagacaccccccacgctgtctgcagaattttctttttccaaaacacaaattggaacagatgtctctctcctactgaaaatccttcaatggcacccactgcctttggaatggggcccgcatccctcggcatggctgaactattgagagatgaagcagggaaggggaaagtggaatgtcgaggtctcaggggaggaggcatcagggaaggccctgtcaagaggacagaaggaggcaggggccaccaggcagttacccctgctaaggtcccaccaggcagttacccctgccaaggaccctctgtgtgctcaagggcagccaggagggtggtgtagctgggacagctggccatggaggattgcaggggccgttgctggtcttgcaagtttaggaagttaaactcacctgatgaggagggaagggaggcagacaggccagaaggcagctgaaatatcttgtggccaccccagagggtcacagtgcactccacagtgggtggcatttacctccatctaacccatgtatgtgctactcatctatcttgctgctatctgcttcttatctctcaaatgtaagctccatgagggcaggaatttttgaatattttcttcactgttatacccacagttgctcttgaaggaaagcaggtccttaaaagatatttgttgactgactgactgaatgaggagcgtgtgagtggacagtggggcggagtggggctgggatgtttggcagggcctgaaaggtattgaaggtgacggccctaccctgagaaaagagcagagccatcatacagcttcaacgtggggcaacgggattgtgttctccccatgagtgagaagtgtcctcacttgtccacttctgcctgccctgcccaaatggtggagcagattcaaggggcagggcaggaagaagtggacaagtgaggccatgaggagtcctgccgagggatgccggtggctgagacaagggaaaaatgaatgtcccaagagctaggcagggaaatcagtagcctttggggtggctttgcatatggctggcaagggaggcaggaggagccaggggccacaggggtcaggctcagggagtggggcgagaggaggaccctggggcccactgggcttgtcaggcttgtgaggaaacgtcaggggctcagtgtgagccaggaagagctggaggatgtctgaacattcacgaggagctgataagcagccgctcagggcagagttctgggccagcgaggggagctgtaggagtgttcagaacacagatttgctggaggtgggcagaggagagcgggcctcgggcaggaggtcagcgtgggatatgggcccagagctgtggtggaggtgagcctgcttcacagccaggtgcagatgagatggagactgcagtcggggcaggacaccaggacggccccagggaggccctgatggagagtttccagaagagggagttgttggccaggggttgctgccctcaggccacgcaggaggcgaggaggcagggtcatgcgtggcctcctgggcagtggggctgagggtacctgaggggtgggcaggagctggcgctgctgtctctaacagtcactctccacctccttccagttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatacttttttttttttttttttttttgcaacctgataccttgaaaagcttctatgtgtctctccttttgttgcctggcagctgtctaggatgatcactgattactatttactaagtagccacatgcaaataaaagttgtttggtaaaaaggagcagttggtcgacttcatcttgttagcatctggaactggccatcaggtactaggtgctgtcagtaatttcaagaaaagcaccccttggagcatttcacaacctaagttctctgagggtgggatcccagcccacccggccttgcttctagagcaagagcgaagggaggtcacatttg

SEQ ID NO: 14450 - DNA, 103894 bp, Human
  misc_feature (1)...(103894): n = A,T,C or G
tgtaacacagtgtttctgactgagcaccttggatcaactgggaagagttaaacacaggaatgcttaggtccaacattgaaacaattaagacaggatttctgggagtgggacctaagcaaggatatttttctgaagctccctagatggctctgatgcaaagtgaagattgagaactactggtgcgatgattatgtatgccagagaccatgactttaagttcttataaaggaataaggtagtacataatagggataatattacaaaaaaccaaacgtacaaatagacttgttcttgcacacttaagagagatccttggaacaatcctccattaagaaactacgacactaccatgaaataatttttcatccttatagaaagcaggtaagattgactaatagaccacaactactgtctacattctcaaaatccatgtgcctttccaaaattagctacgtaactacagtgagagagaaaaaaaaatgtgagtaaatgtcttgtgaaaaattccacttggtttggaaaaatttttgcctgcttttccacattttctaagaagaatctaaagatcttggccaacagtgtcccaggtaagagaaaatcgtgcttgggtatttccatagttctacaaactctacctggataaaagtaatgaaagaggtcctaagaagcttgaccgcactgtgatcaccaccatgggcactataccagctctgaagcccagaactgtctttgagaatattcaatctgccctagaagaaataggagaacaaaactcacgtgttcctagcctgcaaaacagtcggtggagcacgtatatgtaaaaatagaaaaggctggcaagaccaggtcatatttaatattcatgaggcacaagatatacaacacgcacttaatattcattaatcagtatatattcataatatactaaatatacaggagatattaaacgttcacgggtcttaattctgccacccagtggagacactcaaaagtgatctcgccaaagaaatgcaaaacctgtacctgcccaccaggctattagcatgctactgctgtggccaccattctttcactgcatcgccctgccctgcatcggaatatagcaccttgaacacgggatcaggtttactgaattctgtgacccacgctgggagctcaataaatgtttgctaaacggaaatgaacccaattcagaccgtgtagaaaccccagattatatcttttctccaaacattcaatttctaagcagtatttttgaaaatgcgtgatggctaaattcgagttatcctttttgtatgtatgttaggcacacaaccggcgatgacatacaaggcgaggtgacaccactgcactcccagcccgcacgtcacctataagcacagggggcttttggtgctggtttattttcgaaggctggtacttctcttcgatctaagttttaggaacctgtgctcgtcgacggctgccaatactttttattttcaaggctgacgctcgccagagtttcacaagctgctcccggacgctgtggtctctcgctagagtggatccgaactctgcgtgacgctgggaacggccagcgtctgttgcctcacgaaaacatctcccacaaggtggccgcctcgcgcgaggtcagcagcagggcaaacagggatgcgtgagtgactgacgtgagctaatcgctaatgacaggcttcacagccccggcggccctcagagccaggcacctcgcacccctcctcctcctcgagacccagtcccggcccgcccaccgttcccacgccgcccaataggcgccgacgcgactcagcgagtggccggaggaggaggtgttgggacggccggacgctgaacggccgttcacgtcaacgtagtgacgtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgaggtgagttgcattgtatgagcgaagagttgtcagctctcctgttcacagattttgggtcaactgtgaggccacagcgctcatcttggtttctcttacaatgtacctacataatgttgaaaggtacatcgtgaattgggatgctaacccatcctgattaggtatataccctcagacattctttaaaatttcacacatctgcttcaggaaccgtcgaaggacctctgaataaaatggaagtgggttccaggagaagattaactttaaacttagaggagtgggttttactttcgctaaattttccccaatttaaaaataatattcagtttttctatctttagatatatatgtatgtaaaatattttttgtgtatatatatttgtggtttgatcttaaacttgaccagaaactgccttagaatctcagaaattgactttgcatgtggtatgctttgtttgtatggcattttaaaactgcggagcatatagaagataattacatatgcattgtgcatattagaaactgagatttctgtttcctttagaaagaaattcctgttcatggaattgaatcaacagcgaccataccttttacacagatatataattcaaaagttcagttctacaaacgtaaacttttggagctatgcagttcagttactgcagcatcattgtggcttgtataattgttgaatctttccagaaatgcttttactttcatctttaaagagttaatttagaagatttttttttatgaggtcggtatggaaataactgcgtccctttgtgagtcactacaaaataatatttgttcagttcaggagtacatatgggagttaaagtgcttgtgtataaattgttgactttcatcttaaaaggtgctgctgctattcagtgtcttgttctataatatggctttaaaaaccatgtgtgtgacctacagatattttctcaacttgaatatgcgtatatggcctctggttaatacagacagccactgttggcagaattcatcacagattgcatacccttcccaccccttactcccctcagcacctcgaaaactttgctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggctattttccaggtcatgttagtggtaggctttccatttcctgttgtgacatgttggtcataattttcagacggctcaggaagccagatttgatctctgtggtgggtcttatatcaaaccagtatcctgtggggtttggccactatcactgttttgtagaacttccaacttagtttggtagtcaaacttgtcagcagtgatctaaaatgtataatattttataataagtgttaatatttgttgaatgcattctgtgttttcaggctcttttccaagtaatttttgtgaattatctcaattttcacactaaccccacgaagtaggtactttcactaatcccgttttacattcgtagaaactgaggcacagaaaatttaactaacttgccctacagtaactgtcagaactgagactgaagcctgggagtatgatttcagagttcctgctctctgctgcaccatagtgtagtttagaatagtcaaaatgctagagaaaaacaaggagggacgtggcttgtaggttcaattataaaagcaatgtaaaattacagagagtctgggaaacagtgtttttaaaaggaatactcataatcttactactctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataattgaacagtttctgtcttttaaaatcatgaagactatttagttttcaaagtttctgtcttccacagcaactttttattggtttattgttttatctttcttccttgttataatctgagtgttatatttgtatgtgtgtttattccgttgtcctcttgaaagcctctagcatttatacccgctgcccctgaggaatttgggtttttttgtctgtttttatttatttttaattgacagataatcattgtgtatatttatggggttcaatgtgatgttttgataaatgtatattttgtagaaaggttaaatcaagcaaattaacacgtccatcatatcacctacttgccatttgtttgtggtgagaacgtttaaaattaacttttagcaattttgaggtatatagtacattattattaattatagtcaccgtggcatgcaatagatctctaaaacttactcctctaactgaaacttggtattctttgactaacctctctcctttcctttttcccccttctccctagcctttgtagaccaccattctgctctctgcctccctgagtttgacttttttttttagattttacacatatgtgagatcatgcagtatttgtttttttgtgtcttatttatttcacttagcattatgtcctccgggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcctatttttgctcccctccccaaattctggtggcatattgcttagtgtttgcagttttggggctcaggtcagtgtaatggaggtaaccttctttatagtctgacctggaatagaaactaaagcctcgacatataatcctaaagttggaaagaacacgctggtcttgagttctgtgagttgcaggagactgaaatttgtttctgccaactgttttcagttaatcaagttggaaccttagtggatatcttagattcttctttaccattccctatatcttattaattaccaggtcctcttaaatatttcttcaaactctctctgcttctcaatattgatgtgtcttagtgagcagggtaaaatcacagccaaagtattttttaattctctcactcaacacaacaataattaacacagaagacttctgtgaccagatgcttgggggtttctccccccacagcaaccaaccagttagttctgcagcagataccaactgggtgccccccggttccaatacggtgtacctggaggtagtgtcagacaccactggttgagggcagttcccaaaagacttcccccacttccagtgctaatcgcaagccccaggttattttgattttgcctgtgcttctgataacactggctataaatcagggatcccatgacccccccactccttacgtccttgggttcaattaatgtgctagagcagctcacagaactcagagaaacacttaccggtttattataaaggatgttcaaaggatacagatgaacagatgcatagggggagataggggaaagagcatggagcttccatgccttcccatggtgcgccaccttccaggagcctccaatgttcagctatccagaagctctctgaatccactccttttgggtttttatggaggcttcattacataggcacagtcaacaactgtgtagaaatgtgattggacaaaaagagtatgacctaacagcactaatagacccagtggggaaacccagcaaggcctgcctgtccaaattcttctgcctgtctgcagcattccttcttccagggtctggggcaagctcccttctaaagggaaggtcttatgacccacagtcagacaggctgtggaagattagagttctgccttgggttggtggaaaggagggcaggaaaaggtcagcaagagaagagattctgttttctgaggtttaatgtgccccaacattatacaaaagactgtagtaaggccaggcacagtggcttacctctgtaatcccatcactttggaaggccgatgtgggcggatcacttgaggccaggagttcgagaccagcctggccaacatagtgaaatcctgtctctacttatataaaattaaatttaatattaaaaaagaatgtaataagagctgtgggacttataaaccaggaaccatggatgaaaaccaatatatatcatatcactcttaattcagttatgccctatcttacgtttagaattgttcagacgtctagtctcatctccagcttctctatctgtagtccttcagtctcttacccttcttatctggctttcacactgctgctagtgttggcttactaaaattcatgtctgatcatgtgatttctctaaagttcttcatggtttcccctgtgtatagatgagtatgtaagtttcttagtgtgacacatgaacccctccccttcatgatctggcctatgtctgcctctgtagctactctctggtcctttacctcttacataagctacccaagcaggttttactatgatgcttttatgctgttgcgcatactttttttgtgtgtgtgcctgtattgactttttacctcacagcccaattaatttatcctaattcttcaatattttgctaaaatattccctctattaagtgcttacggactgtttgccagccagcttgcttacttttctcaggtttatcaaatacattgtatgtacctctcctgtgatgtgtatcataccatattgttgttacttgttgatgtctgtcaccttcactgccttaggaacagaaaccatatcttattcattaccctagcatctggctttgtgcctggtacatgctaagtgtgcagtcaatgattatcaaataaattaataaatgactccaaaaactagctttgaatactagataaatggtgatcctgtaaactgagataggaaaagtaggaggacaaggacttttggggcaaatatttatttagtttaggtcttgttgagttttagctcttttacaacatcaaggaagacatgtaccatttatttcttatacatttgttatttattcatacaatataattaacccaacaagattttttttagatatggacaagattattctaaaatttacatgaaaaggcaatgaaaaagaagaataaggtgtgaaagatcaatctactcaatttcaagacttattatgtagttacagtaatcaagactgtgtggtatgggcatagataaagacacagatccgtggaacagaacagagaactctgaaatagatccacataaatatacctagtttttgtcaaaagcatgaaaacagttcaacggaggtagataactttttcaacagttggtactggagcaattagacatccatacactgtcccattcccaaccccccaataaaggaacctcaacctatgtctcataccctgtgcatgcacaaattaaaatggatcacagactgaaatataaaaatattaaactataaaattttaggaaaaatagaagaaaattttggggaggtagggttaggcatatgtttctttgacttgccaccaaaagaatactccttaaaggcaaaattgataaattaaacttcatcaaaattaagtatttttgctctgttatagaccctgttaaaaagatgaaaagataaactagagaggggagaaaatatttgcagacaacacaactgacaaataactagtatctgtaatatataaagaactcttaaaagtcaacagtatgaaagcagtccagctagaaaacggacaaaagacatagtcatttcactgaagaggattacacatatagcaaatgagcacataaaaaatgttcagcatcattacccattagggagatgcagattaaagcaacaagatactaccgtacatctatcagaatagctaaaataagaaatagtgacaacaccaaatgctggcaacgaggtcaagaaactggatcactcatacattgttggtagaaatgtacaatggtacagccactctggaaaacaatttggcagtttctttaaaaaacaaatatgtgactactgtatgacccaactgttgtactctgacatttagcccaaagaaataaaggctattcattttcaaaaacctgtacatgcatgtttgtagcagctttattcatagtcaccaaaacatagaaacaagccagatgttcttcagtgggtgaatggttaaacaaactgtggcatatctgttatcatagactactctgataaaaaggaaggaactattgacacatgtaacaccctggatgaatctccagagaattgtgctgagaacaaagagttaatccccatatcatatcatttatataacattcttgaactggcaaaattattgaagtagaaaacagactatgggttgctaggggttaaggagggatggccataaaacggcaacatgagagatacctgtggtgatggaatattctgtatcttgactgtatcaatgtccttatcttgattgtgatattgtactatagttttgcgagatgttcccattaatggaaactgggtaaaagatatacaggattttttttctgtattatttattgtaactacatgtggaaccacaattatctcaaaataaaaatttaattaaaaaaattgaacatctactgtgacacattttttttttttgaggcagatcttgctcagttgcccaggctggagtgcagtgagtggtgtgatctcagctcactgcaacctctgcctcctgggctcaagtgattcttctgcctcggcctcctgagtagctgggattacaggcactcaccactatgcccggctaatttttgtatttttagtagagacggggtttcaccatgttggccatgctggtcttgaactcctgacctcaggtgatctgccctcctgggcctcttaaagtgccgagattacagctgtgagccactgcgcctggtctaatgtgacatattttgctaaccattgagtatacagtgttgagcaaaaattgagtgtcagacctcatgacacgttctacaatggcagacagatattaaataatcacagaaataaatttaatattcaactgtggtaagtgctgtaaaagagagctataagaactaataatgagaaaatttgatccagatagtaagtgggtcagcgaagctttgcttactaactgcatgactttgggcgagttatttacatgctttgtgcctcagttcctcatttttagtggggacaataatagcacctattctttaaggttgtcatatatttaatatgaatattaaatgaatgaatttgtaaagggcttaagatattgcctagcatatagtaagctctggttaagagtttgttaaataaagggatacttgatgtaagaccttgtaagaaaaatgagtaggagagttaattcttttttatttttacaatttcaacttttattttagatgtgcaggtttattccatgggtatacagcatgatgctgcggtttggggtacagttgtacccattacccaggaagtgggtatagtgctcaacagtttttcagcccttgcttccttccctacatttcccgcgctggtagtcctcagtgactattgttgccatctgtacgtctgtgagtacctgatgttaaagctcccacttaaaatgagaacatgctgtatttggttttctgttactgtgttaattcacttaggataatggtctccagcagcatccccattgctgcaaaggacttgattttattctttttatggctgtgtagtgttccatggtgtatatgtaccatattttcttttctttcctttttttatttttatttttttttgagacagagtcttgttctgtcgcccaggctggagtgcagtggcacgatcttggctcactgcaaactctgccttctaggttcaagcaattctcctgcctcagcctcccgagtagctggaattacagacacctgccatcactcccggctaatttttgtatttttttagtacagggtttcaccatgttggccaggttggtcttgaacttctgacctcaggtgatccgccagccttggcctcccaaagtgctgggattacaggcgtgagccaccgcacccagcctgtaccatattttctttatccagtccactattgatgagcacctaggttgattctgtgtttttgctattgtgggtagtgctgtgatgaacatataagcacatgtgtcttttatgtagaacaatttattttcttttgggtatatacccagtaatggcattgctgggtcaaatggtatttctgttttaagttctttgataaatctccaaactgctttccacaggggctgagccaatttacattcccactgacagtgtataagcattccatagccttgccagcatctgttgttttttggctttttaataatagccatcctgactggtgtgagatggtgtttcattgtggttttgatttccatttctctaatgattagtgacgttgggcattttttcatctgcttgttggacagttgtatatcttaatttgagaagtatctgttcatgtccttgcctactttttttgtttgtttgttggagacggagtcttgctctgttgtcgcccaggctggagtgcagtggcgcaatctcggctcactgcaagctccgcctcctggtttcacgccattctcctgccccagcctccggagtagctgggactacaggcgcccaccaccacgcccggctaattttttttgtatttttagtagagacggggtttcaccatgttagccaggatggtcttgatctcctgacctcgtgatccgcccacctaggcctcccaaagtgctggggttacaggcgtgagccaccgcgcccggccgtctttgcccactttttaataatgttgttttttgcttgttgaattgtttgcttcttgtagattgtagatattagacctttgtcagacgttagctagattaacagagaaagagacaagatccaaatcaccacacaatcagaaacaacagaggtgacattacaaccaatcccatggaaatacaaaagatccccagagactattatgaacacatctgtaaacacgaactagaaaatctagaggaaatggataaattctggaaacaacctcccaagattaaatcaggatgaaattgaaatcctgaacagaccaatatcgagttccaaaatggaatcggtaataaaaaatctaccaaccagaaaagccctggaccagatgtattcatagctgaattctatcagatgtacaaagaaagctggtaccaattctactgaaacgactccaaaaaatgaggaggggctcctccttaactcattccagcttcaccccgataccaaaacctggcaaagacacaatgaaaaaggaaaagtacaggtcaatatccctgatgaacatagatgtaaaaaccttcaacaaaatattaagagagtgagttgttaaagagaagagggtatgatccaggcagagggagcaacaaaggccttggggcaggagtcaggaaagagcttgataggactgagagattgaaagatcagtgagtctagagtacttcaggaagtacatacttctcaaagtaagatatacaactggccaacaagcatgtgaaaaaatgctcaacatcactaatgattagcgaaatggaaatcaaaaccacagtgagacaccatctcacgccagtcagaatggctattaaaagaagctggggccaggcgcggtggctcaggcctgtaataccagcaatttgggaggccgaggcgggcggatcacgaggtcaggagattgagaccatggtgaaaccccgtctctactaaaaacacaaaaaattagccgggcgcagtggcgggcgcctgtagtcccaggtactcgggaggctgaggcagaagaatggcctgaacccaggaggcggagtttgcagtgagcagcgatcgcgccaatgcactccagcctgggtgacagagcgagactccatctcaaaaaaaaaaaaaaaaaaaaaaaaaagtgctggggaactagcaggggttgggctgcatagaactttttctgctatattaaagagtttgtttcttaagggtagcaggaaatgattaagagatgttaacatggaatggagagagattatgagcaaacttactttttggaaaaaaaaactgtgctggctgcagtgtcatcagattcgaaggaagcaaaataattgcacgtagataatataggaatttattaggtaaacgaggccttattactggaagttttcatagtttatctctgattattattattactttgtttgagacagagtctcactctgtttcccaggctggagtgcagtggcataatctcagctcactgcaactgccgcctctctggctcaagcgattttcatgcctcaggctccttagtagctggggttacaggcggctgccaccacgcccggctaattttttatttttaatagagatggggttcaccaccatggccaggtgggtcttgagctcttgacctcaagcgatccagctgcctcggcctcccaaagtgctggaactacaggcatgcgccaccacacccagcttatctctaatttttataattttgtaagaatatatttacaagctactgtgtatctattacaatgttttgaaatgattataagtatatttttggtgattaaaatggaaaaggtgactttgcattattttttttaaatatgtaaaatttcatctgctgtgttagagtctaaatagccttttgtgcccaagcctgggaattgggtttagaacctgaaaatatttaacactagtgttcagatttccttctgttatatgtcctttatgctactatagaaatttgaatattttatagcagtgctgttcaataaaagtgttagtgctgcaaatgcaagccacataggtaatttttaatttttcagtagccacattaaaaaggtaaaaagaaagtggtgagattcatttcaaatatattttatttaacccaatggatctaaaatatttcaacatgtaatcagtataaaatttctagtcaaatatttgacatcctttttaaatattaagtcttagaaatctggtaggtattttacacttagagcacatttcagtttggaccagccatgtttcaatggctcgatagccgtatgtatgctggctgctgcatcagtcagtacagctctataggtttctgggttaatacgtggaatagtttttttttttatcttaagttatcaaatttatagaaatagaaacccatgcaggcctgggtttaattggtttatttggagcagagttgcatgcttgtgttacaaagaatgatctgcaggctaggtgtctcaaaggtattatgaaattaatttttttaacggaaatagttaaatttccagttaccacttacgatttttgagagacttttagggataaaatggaggagatatattggaatttgctgattgaagtattaacacataaaaaggtttaatgattttacagagatttcttagtgctgtgtagcctctagctaatgttcactgaaatgttatcatatgtattaagcccttctattctgtaaagaaataaaaacagagtgtctgtgttcttcacaaaaatcttagcatacatgctttgatacatcaaaattaaatgattcttaagctattaatgtttatgtttttaaaagccttttggtaattttctcaaaagccacataatatttaatttgtttgcctctatggaactgcagatttcttagtatgaacaactactttcatactttcctattgttttaattaatatactctaacaaatctcatctcagtataatatgccatctttggtagcgataactataaaacattcataaagttgcaaagcagcaagtatttacatttttcttttttaatttgctaattttggttattcctccaagaacagtttaatactcttggagagaggatttttttttaaattgaaaactgaatacatttctctttttgacctcattaattgaatagtttgacatttgttgttcttacactgtgccagtcattatgccagatgtggagagcagaggcatgctctcaaggagctctcaaaacttcacctttttcaaagtgatctttaagttaggaaatttatataatctgtttaaaagatatttattgtcagtaatagtctagttttctaaaacttcataaatacctttttgttattaaagctctttgaggttatctttccatttgcagaaggaaaatttactgagtagaagagattgtcttaaaacactccacgtcttcagtgttagaattcactgctagaattcatcactggaattgaactgtgcttactttagtcttcatctgtcattttctgtgtgtacttactaggccatatctgctaagtcttgttttacaaggcttactggtttgactgcttttatgactgcatctttcaagtcccacccatgcagcttaaaagtctattactaatgtccccatacttatgttgaactcttattttggtgttgagtaagtaagtggaggtatttaaaaatcaaactagttaggagtaatacagatttaagaatatggagagtaagaacaatgaaaacatacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttgtacttacacctcttacacctgataaaatattcaaaaggggcagtctgtctttcaaaccttgtacttcagccatcttgttccctaccctttgggcaacttacttggaactctctcctgagacaaatctatacatacacaagcaaaaatgtaaatatacgttacatttttcaacttaacaattggatatctacctggagaaattcttcattcttttttacaactgtataatgagaataaaattattacctcaccccaaaatacttaataaaggtaactattgttacagtgaatacgcttaattttttttagcacatagatcataactttccttttgtgatgttaaactagatgatttttattgtatgtttgaaaaatgttaaaactactttttcccccccacagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggtaagttcagcatgacagcctaatgtttgtattcatgaatatccactaataaatatgtacactattttattgaggttgaatttttcagtaactttaaaaatttgagatcaaatttacataacataaacttaaccattgtaaagtgtggaactgagtggcatttagcaggttcacagtgttgtgcaactaccgtttctatctcgttccaaacattctcaccaccccaaaagaaactactacatttaagggtaagcttttaaatataatgtaatacagagaggtgtgcaatcatcacatcttagtgtggaaattgatgaattcctacaaagtgaacatttattatataactactcctcaatcaagaagtaaaacattaccagtagtttcagaatccttccttgttccaccttcagtttcaatattattttgatttctatctagattaattttgcaagtatttaaactttatgtatgtggaattcatactgtgtactcttttatgtctgtggcttttacttacgtttcaaaatcatctatattgtcgtgtatagcaatagttaacgtattttcattgttggtgtagtgtcccattgtgtaaacatgcttcaatttatttagttattctacactgatatttcattatttggttgtttttttttttttttcatattttggctattgctaacagtgccactatgaattgtcatgtgcatatgttttagtgcacattatgtacacagttctgtatgatttatatcacagaatggaatgcttagatcatagaatatgtatatctcagcattatcagatactatcagagatacttccatttcttttttttttgtcaattaccctattcaaagatactaccaaagtggatatagcatgtacatttctactagcaatgtgtgagaatactagttactccacatcttcacctatacatgataacagtttttaaaaaattggctattccagtgtggttgcagtagtctctcattttggtttcaatttatgtttacttgatgatttatgagtttaaatgcctttttgtgtgtttattggctttttagattgcctcttttaaagcacctattcagtccttttccctgttttataggagttcattatgcattctgattatgaatcctttttcagatacatgtacggtattgcagttatcttctctcattctgtggtattttttttactctcttaaaggaatcttttggtgaagatatcatcaattctaatgaaatccagctaatcttttcctttattctaagccagtctcagtcacttatgcctgcaatcccagcactttggaaggctgaggcaggaggattgctcgaggccaggagtttgaaaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccaccaacaacaacaacaaaaactttttcttttcctttattcttagtgtttttttttgttctgtttaacaagtcttcccatacctcaaggtcacaaagatattctcctgttttgttctagaagttttatttttgtgtattcacatttagatctgcctacctgcagttaattttttaaatatgatgtgggttaagagttcagattcatttttttcccatatgaataactagttgaccccacaccatttgttggaaaaaactttgctttttctaatgtactacagtgacatctttgtcatgtatcaagtggctatatttttgtagatctgtttctggactttctactgtgttacattgaaataattgtcttatccatatgccaatgcccaggatatatatgagttttgttttttaaatttgtttttgtcttttattgatttatagtctgtttgcatttaacataatcaccaatatgtttggtttcagaccatcctctatttgttttctgtttgtcacatctgttctttcctctccccttatttctgttaccttcaaaaccttgttatatgttctcttactttttgttcagtaggctaccctagagattattacatgtatccttgatttattagttctaggcattggtacttttaccacttcatggaaaatgcagggacttcagaatactttacctctttttacccctttctgcttccttaccattttctcaccaggaaataggtcaagaatgaaaatggttgagactattgggttttacctttctttgtttcacttcttttcagaatattgacacttcaagttctggctcccttggatatttactggtttaaaatacaatattttgctgttatttgtcatttgctgtctttatcacagatttttttttctaattttaatgacaaaattataaacaagaaaaatacatatattcataatttgaaacaggtgaaattaatagcatacccattttttctgtgtttaaatagctctttagccctttatgtgaggcagaaaattaactccaggaagtagaaagatataggaagagctgactccttccaccttcccacgttgccgtcaagtgctggtgatgtctttactcatggtcttcaacaggagagagtgccaagcagtaaggatggggcaagggcataaaaaggatctatttgtgttgctcttttatcagggaggataatttttctagaaccttatcattagacttccttatgtgtcactggccataattgggtcacatgcccaccccaagactgataactggcaaaggggaatgaaattactgattggttaggacaattatgattccttctctgaaattaggcactttaacatgcaaacaagaggaaggcccaattagcacgtataaagttggaatgactatagcgtaggcaaccattggtgttttcttttctttttttggagacagagtctcgctcttttgcctagtctggagtgcggtggtacaatgatggctaactacagcctttacctcctgggctcaagagatacttgtgcctcagccttctgagtagctaggaccacagttgcacaccactagacccagctaattttttaaaattttttgtaacaatggggtctcactgtgttgcccaggctggttttgaacttttaggttcgaacgatcctcttgccttggcctcccaaagtgctgggattacaggcatgagccactgtgcccagtctattggtagtttatataaagagtctgtcctcaaagttagtgtagttgaaggtataagttgtggagtagcagtcaaaaataactgtgtgagttttaaattcggtggtacagattccaaatgttacatgtcaccaaaaaaagatatcattttgatatccctttagaattgggaaggttgtaaagggaagataatgcatgaagatccagcaatagggataattattatatatgtgaaacagtgaatgtccttttttaagacagtgaatattctttctttcaacatagctgatattcttctgttaacagtagcagggaggggaatgtcttggaagaagttggagcctcacattaggtctctcactatgggttaaggcagatttcagaggaaaaaacttatttctgtttctgctcagtatctggggagtatggaagtggttagtaagtcaagcagtaattcttcgtgactccatatctttttagcataccaaaaaataactattaccagaaggtactgatagtgtttttttgaatatgtgttgaatgaaaatccatgatgttcagtggctttcaagttggtgacctgaatttacatcctggttctgtcacttattctctctctaacttttggcaagtcacatagcctgtttatacttcagtttattcccacgtacaacatagtagtaaactcctaaataataaagtctttaaatgattgctctgagaattaaatgcatatagagatcttaacaaataatgcatatagaatccttagcagtgtgactggcttatggtaaggtaaggactcactaaatagtagctgtttctgttttcttctagattactttccctttggatatgttagactctgtacccccaacgtaagcagttttcttttatgttcatgttcaaatgagatgtcagtaacatctctactagtattaatgaaaagctgtagctctagaactcaaatatgacatctggattaggatttagcttgtcagagataaactgctttggaatctactgacttcagtagatatctgttgcatagcccttgctttgaaagtaactatgtgtacttaataatctcaaaaatgtaatcaatctgctcagagtgagtgctaaacaatctagagtacactgattaaaaaatagaagttattctgtataatgatgactagtagtatcagtcagaaatgtcagctagcaaaaagctgaaaaagtaggcctgaaatgtgtttatattaggtatatctaatttgaatgagtcattttggtcaataattcagattccatggaaaatgcaaaatttttttattgcaagtaacaggaagggagagccaagattttgttgccagagttgtattcattaaagagaaccatatggctcttgactcattgaaaatgaagcacatgactgttcatgagtgcagctttagaattattcttataatagatagtactatcttcacttgaagtaagagaagttattgagattgactgatggggtaaaaactgtgatcagccatgtttaagcaaattaactttcagtagttaatttatgttgataacgtgattatgctagtaagtttaaaatttaggcgcctatatccttttttatcacacctgaaatgtttacttgacaacatcaagggtctcccaggtttctgattatgtatagactgagagggaaatgtgagaggagtaagagttgagagggctcactcctaagtgtttgatttcctatctatacataactttaaaaaataaaaataaaaacagccttggaagctgggtgcctgtagtcccagctgcttgggaggctgaggcaagaggattgcttgagcccaggtattcaaggctgtggggtgctatgatcgcacctgtgaatagcccctgcactctggcctaggcaacagtgaaacccagtctctaaataaaaataaaaaacctttggaaatactaaaatgcaaatgtgaggttttctgatttattgggaatcttggggcatgtgataactgggaatggaatccagagaaattacatagattattatattctacttcccatatatgtaacattctgagcttcagaactcagaaaccacatagtagacaaggctcagaggtggactgtcctggtcaaggtgttgtgatcctaccacctgtgctaaaacttaagctaccttctgagctattacaagagattccagtattttcattcaaatatctattgttagattgagctttattcaaaatatttgtaagtttattcatctggtattcttctgggtggcatattcataactactgcctacacaagacgtttcaaaagaagaagcttggcaaagtagatgcagagtgataatgccagaagctgagtggccatctcttagtgtgaagacacctcctagagtgagggtacacaacacaaatacagggtccagcctttcctcctgtaaacgcagaaacatggcatcaacatgaaactagctgtctctaagaggcggattcatattaactagggttttagatctcattaggtaaaaccataatacaaatgtatttatagtgagaaatatactaataatctacttcattccaaaaaaggatataaagcaacttaaagggataaacagaaattccatcatttgcataagtatctgacacagatgaagcaaagggaaaacaacttgaggtgacgtaaaatgtagatatgagaccaataaaagttaccaatatacattttaaaatttatttttttttttaactttaaaaaatgttttgtagagatgggatctcactatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagccaccagaagtcatcttaatgaaaagtaaaggctatgccaatgggcaaagtcaggagtcttcattcaaaataaaatatatatatatttttgaggcagagttttgctcttgttgcccaagctggagtgcaatggcgcaatctctgctcactgcaacctctgcctcctaggttcaagcaattcttctgcttcagcctcccaagtagctgggattacaggcacgcaccaccatgcctggctaattttttgtatttagtagagacggggtttcaccatgttagtcaagctggtctcaaactcctgacctcaggttatccacccgcctcggcctcccaaagtgttaggattacaggcgtgcaccactgcgcctggcctcaaaataatttttttaaaaaaattcagggtctcattctgtcatccaggctggggtgcagtggcatgatcacagctcactgcagcctcgacctccatggactcgagtgatcctctcacctcagcctcccaagtagctgggactataggcatatactaccacacccagctaatttttaatttttttgtagagatggggtatctcactatgttgctcaggctgatgtcgaactcctgggctcaagtgatcctcccatctcggccttccaaagtgttgggaagctgtctggctcacagtggtgaatacaagttttccaaaatttagtttttgcttgagagctcaaattttttttattggcaacaatatactgtcagttgttttacttgaaaagacaggttgagaaaatgtctggcaaaatctttagcctaaataactaaagtgagtgtgtcagtttttctttcaaagaaaaatggtttaccatgaaaaatgttcagcccacaactcaaatattcagataagtgcttttcctcaggacggaacattgtacaacagtatgagcgaaagtgttctgttcgttctttctactttgttacacagaatattaaaaagatgtgtactcaagagttgtgatttaataaaatgaatacttactgttttatcaagaacatttggaagtgaaacaggcttttgttttctgcaaattcatgttgatgaaaaatataacaactgcttttttttttcttttttttttttttgagatggagtctccctctgttgcccaggccggagcacgatcttggctcactgcaacctccgcctcccgggttcaagcaattctcgtgctttggccttctgagtagctgggattacagatgtacaccaccacgcctggctaatttttgtctttttagtagagatggccaggctagtcttgaactcctgatttcaagtgatccgcccgcctcagcctcccaaagtgttgggattacaggcgtgagccaccgtgcctggccaatacaacaagttctagtaaattttggtgccactgttttgatttatgctagatatcaagctgtcttcctcactattgcttttgtactataaatgaaaggccaatacaatgaacaagacaaagaatgttatggtctgcttaataatggccatccccacaccgaattcccaaaacctgtaaatatgttacctttcatgttaaaatggactttgtgattaaatatctagagatggagtgattatcctggattatctgggtatctctgatgtaatcacaagggtccttaaaagagggaggcaggaggatcagagttagtggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacacaccttgatcttagacttctggtctccagaactataagaaaataaatttgtgttgttttaagctactaagtttatggcagtgtgttacgataacagtaggaaacggacacggatatcttagtattatcgaaagtgttgtttttaaccttgtggacccctgagaaagatttttggggtctctcgacaattcttgaccacactttgagaattctaagataagctagctgccaaatgcacactgggtacatgaataaggtgacttgttatattgtattaaaaactttaagagtgaagggtttatataaaaagggtaaaatgtacatatatgatttcccaattctcttcaaatattatatacacacacagaaaaaacattggaggaaaatacaccaaaataatgtgctttttcttcatgatggaatttggggatttataatttttctttatactttcagtattttccaaattgtcagcaatttggctgcagaattagaaaactgaatttaaacttccaggtcattccgaggtatatttgtatataggatagaacatattaatagtttaaacttgatgtataactaaatattttgtccatatggtaattgggccttctgttgtactattgccctggcccttgtaaatgttaggtttgagcttgtgcctggctgtcatttttccaggtctttatacatggtcctttgtctagaatactagtagtattccaataccaagtagtgctaaagtactacttttactttgcttcttaaattagccctcagtccctttagtaagccttaccttactactcagttaaagttaagggcccctcgtatgtagtaaactgggtgttgcttctattgtgcttgcattcttgactttatctgtatttgtcttacttgtttatagcctgccctcctcctaaattgagcaacacattttttttcagtaaaattatcctagtaatttctgttagtttgtaagtaatttattttcctatgtacatagttctgtttagagctgattcattacattttgattacatagtttaactcttgatgagcattcttatttttttctatttccaagttttgtggggaagggatattcatatataatgggcagccatatatactgtttattttatccttccttcttacaaatgtctaatatattggcatgcatagagtaggagctcgttaagagtttacttctttgtaaaatagtcatctattcaacatattcactgctcatattttataccttttaggagtcttttttcctttttaattattatttttgagacagagtctcactctgtcattcaggctagagtgccctggtgatattttggctcactacaacctctgcctcccaggtggagtgttgaagtgattctcgtgcctcagccttccgagtagctgggactacaggcatgtgccaccatgcccagctaagtttttatacttttttttttcagtagagatgggtttcgctatgttggccaggctggtctcgaattcttgacctcaaatgatctgcccccctcggccttccaaaatgctgggattacaggcgtgagccacagcactcagaccttttaaattatcgaactaatacagttatataaagttttggtttagctggacactaaactggtgggttattcagtagagtagcaggatataagccacttatctatattgttaaactgtattgcataagggcccaccaaaatggtagtgtaatccagaaggaaatagggatagaatagaaagccaggagaaaaccacagaggaaaatggctacctgcctgacattagtcagtgtcatcacacccttttagattttctcatctaaaaaatgaagggaaacatatctattctacctacctgattcagattagttttggaaacaaaagaatacggtagaagaaatgatggaagtgttgctatttaatattatatgtgagagtcctttatgataattttagcctgagtgcccaaagtttaaacttacttatactttctgcagctatcaaacagactacctacatcatgacattcagatagattatcctgggttcataaaaatcttatatggttggctgggcgtggtggctcatgcctgtaatgccaacactttgggaggctgaggtgggtggatggatctcttgatcccaggaattcgagaccagcctgggcaatatggcgaaaccctgtctctacaaaaaatagaaaaattagctggacatggtggtgcttgtctgtggtcctcaatatgcaggaggctgagatgggaagatcacttgagcctggggaggtcaaggctgcagttagccgagatcagccactgcactccagcctgggtgacagagcaagaccccatctcaagaaaaaaaaatcttatatagttaactttaggtcttagtaatgacttggattgcctaggagaaatggcagagtctaggactgagagagtagaaatacaagatgtggccagagtgtcttgtagtaccaggagtgaagaagtactcataaaacaaaggatgggggcacatcagaggaacacaggaacttacctgaagaagctcctaagggtcaaagctggaataatttgagcaacaaaaataatgtagcgtgaattataactcaaagtataaaataatcccatatatatgatataaaggatataagttgacataaaggattgaataaatatgaggcaaaagagacaaatctcccatcaaataatttatgtacccattccattctatggaggagaagctcaattcctacctcccttgagggtggactggacttagtgacttacttccaaagaatagagtagggaaaaacctggaaaacactatcttagccaaatagtgaacattaatatcaccagagataaatcatagatatcatgtactcttgatatgtgacaagaagagcatgtcacctttgtgatagtgtttccaaagacccataatcctagtctaatcataagaaaagcaactgatgagcttagactgaatgacattttacaggatacctgactagtcaagatcatgaaaactaggaaagactgaaaaactaagaccgaaggagttcagggagacaagatagctaaatgcaatgtggatcctgtattgggacctggaatagaaagaggacactcatggaaaaggtgctgaaatctatgtaaagtctggagtttacttaatatacaaatgtcaagtttcttagttttgacaaatgtatcatggaaatgtaacgtgttaacaattggggaaactatgaatgagaggtatttgggacatctctgtactatctttgcaactttcataaatctaaaattattccaaaatgaagtttatttttaaaaatggactggagttaacttttaaataataaaagcaaaatgtgcttattgtagaaaatataaatgatgaaaaatataaggtagaaaatgaaaactacccataatcctaccacccagagataactgattatttggatatgtctttttctagacttaattctatgtgtatttcactcagcaaataattattagactcctttgtggaccagacatcttggtaggtgctaatgatagagcagtgaagaagaatgatgtgtccttctcttatggagcttatactctagtgatagagggtactattaaacaatctcacaaaaaaagttacaactgtgatacgataagggctgtaaagaagtatgaatgtcagccaggcacagtggcttatgcctataatcccagcactttgggaagccaagatagatggatcacttgaagccaggagttcgagaccagcccaggcaatgtgactaaaccctgtctctactaaaaatacaaaagttagccaggtgtggtggtgcacacctgtaatcccagctactcgggagactgaggcacgagagtcgcttgaatccaggaggcagaggttgcagtaagctgagatggtgccactgtattccagcctgggtgataaagggagaatatctaaaaaaaaaaaaaaaaagtatgaatgtgagaacatataagtggggaaatcaaaattgaatatgtattatttaagatgagaactgaaaaacgaatacaagtcaggcatgtgaaagaaggaagcagggcattggaggtgctaggagcttgtacaggtgcagttgcaggcagagggaaggaacttggagcgttagaggtaaaatgtctggagtgcagagaatgataactagaaagcgagggactgaggctgaagacgtagctaagcaaggtctaaataatacatgtaaagtttttggtacttttccccaagagtggtgggaaaccactgaagatttttgaatcaagggaatcatacgaactttgtaatttaagaagatcattcagaggccatgtgggcaaatggactgttaggtggtgagagtatggaggtaaatataatagttcagaaaagaaattatagtgtctaggactataggtagtgatagagagtagagagattcaaaatagatttaggagtaaaatcagccagatatactgattgttttgatgtagaatgagggagtataaggataaatgttctgtatttctagcacatgcagttggtagtgccatttataaggcagagagtttttaatatataaaacactgccttatggtgcaagagcttaatcatttttaatggttgcataataatcagatacacaaatgtattttcagttcccagaaataaaacatctgttaatgtgtagtgaatatgatgttttgaaaattagtggtgaaaggctgggcgcggtggctcatgcctataatcccagcactttgggaggccgaagcgggcagattgcttgagcccaagagcttgagaccagtctgggcaacatggcaaggccttgtctctacaaaaaatataaaaattagctggggcatggtggtgcacgactgtagtcccagctacttgggaggctgggacgtgaccattactggagcctgggaagttaaggctgcagtgagccatgatcatgccactggactccatccagcctgggtgacagagcgagaccctatctaagagaaaaaaaaaatgagtggtggaattgttgctaaagatagtctgagtgctgataaaacagttgagttggttctttctgtgactaagaataatgaagctctttgtttgatattaactgctggtagaaaacattaataaaacaatccaagaaaggtgttttaggaaacacagtattctcgtatgtagatttataagcacagaaaaatttccaacagtataaagttgtggtatagctccaagaaaagtattcttagttagaagaatttggctttgctacagagtttcaaaggttatgtgtgcgcatattgtcttcagtagatgacaagttgattttagttttattgttttatctggcattttccaataacattggtagtattctaatgagtaagacatttgactctaaagtcaaatttgacaacatatattcttaagccagtttagaaagtatagaatggtggttacattgtaaatctttggcagagtttttgtaagaaattcttaaatgaagttaacataacactgctaccatttaatgtctgtctgttgggaaaaggtcagagctcttttaaatgctctactctgaattatttttagaaataaacaaataattctaaagttcatctgatatttattctaagcagggtcatgttcttaatacatttgacacttcacattctgttgccaactactttgtaaacatttctacacctgtgtctccagactgcttcagccagagcaacttagttaacctattatacttatatgagggagtaggagactgcccaaatttgtgcgtttatataagagtaaggtaatgcatttagggaagacaaactcatactaggtttatgaaatgctgtaattcaggatgttactaatgaactaggaaagaagttggtattaataataaactggtgccttgataaaattagcctaagcatgccagtggaaagtcaatcaagtactggatagatatcatcagaaaggtcattggaaagaaatcagcttaattttataatatacagaaactggtggtttatacctcacttaccaccttaattattgtcattgcattgcaaaaaaaatttttcttcttaaaaaaatttcaaagaaagttaactaaaatgattacctcttcactctacctttctcaccctaatatcatgatgcgacaaattaacttttcttctgtgcatgtagaatattacctatgaactgtccttgggagaattgagaaaattttcaagcttcatgttttgtgttgtggttctggttaagaatttcagttgaaaagggctggaggagttatgtgctaaacctgtaaaatcataagctgaagcaaatatagtcatttcttggtatttgtgagagtttggctccaggagcccctcaggtaccaaaatgcatggattttcaagtcccctatataaaatgacatagtatttgcatatcacctacacacatcctcttatatgctttaaattgtctgtagattacttatgatacctgataaaatgtaaatgtgtaaatagttgtgctactgtattgctcagggaatcatgacaagaagaagaagcctgttcatgttcagtacagaacaaccatccatttttttcctaaatattttcaagccatagttggttgaatccacatatgtggaaaccacagatgtagaatccctggatacagaagattgattatacataaaataataagtctatggacctattttacacagttctgaaatacagaggaaattccttggaaaaaccagcaccttagaacacattgaagtcagtttagatgcttatgaaatttgttacctacaactgattgagactgtaaataagattaaactagaagggtttaggtagggaaaaaaagaagaaatccacattagatattaatagaattagagatacttaggatatgtttttaacttaaagacttttgaattgtgacataacacatcagaaaatgcataaaacgtaattgtgtagtttaattagttattacaaagcaagcatctttgtagcccactgaggttaagacaataaagcataaccatattccagaagcctcctgtgtacgttcctaatcacaacccttcctttccctctgaaggtaaatactattttctctttgtctaatcactttcttgctttactttgtggtttgctcatctaggtatgcatccttaagaatataattcattcaagccagaaatggtgtgttgaaaaaagaagtatataatttaggattgcctgtttttgaaagttaagtaaatggaatcatatagtgtatatgtctttgtttcttggtttcacacaatgtggctttcaagaatcaggcatgttgttgcaggtagtagctgtgtggttgctctaaactattatatatcattttttaaaaaatgaatttactacagtttacctattcattttacttttgatggatcttgaagctcctaacaggttttggtggttactaacaatgctactttgaatattatgcatgtacttgtgtggtacttaggtccttaggtgcacaaattttatttgtcctggatgtgaacttgttgggtcataggtcatgttttccccagtagtgtttcagtatacattcagaccaagaatgtatgagagcttccattgcttcatgttcactaaccacttgatattgtcacacttttaattttgtcagtgtgctagctatgtatggattttgattgtggtttaaatttgcattttctttgtagtcaaagagatgtagcatcttttcatgtctatttggaaatccttttcagagtaccagtttgggtcatttactcatttttctattggagtgtctatcttacaggatttgtagaagttcttctattttctagacacaaactttttgttggataaatgtgttacagctatcttctatggagtgcatttcactcttctaatggacaaattatgaacaaatattcttagttgtaatgtggtcctatgtgttaatcttttgctttatggccaaggcttctttgtgtcttaattttaaaaaacgtccctaccctgatgttatgaagacatttttctatattattttgtaagagctttgccgtttacatttacctgtgtagtcatctgatttgtatatgtgtgtgtgtgtgtatgtgttagagtgtattcatttttttctcatatagatagtgtgttagtctgttttgcattgctgtaaaggaatacttgaggccggacaatttataaagaaaagaggttggctgggtgcggtggctcaagcctgtaatccctgcactttgggaggcccatgtgggtggatcacctgaggtcaagaattagaaaccagcctggccaatatgataaaaccctgtctctactaaaaatacaaaaaattagtcaggcgtggtggtgggcgcctgtaatcccacnnnnnnnnnnnnnnnnnnnncctgtaatcccacctactcaggaggctgaggcaggagaatcacttgaacccggagggtggaggttgcagtgagcctagatcatgccaccgcattccaggctgggtgacagagtgagactccgtctcaaaaaaaaaaaaaaaaaaaaaaaggaaagaaaagaggtcgtgcaggctgtataggaagcatagtgctggcatttgcttctgtctggtgagggcctcaggaagcttccaatcatgatagaagctgaagtggaagcaggcgtgtcacatggtgagagaggcagcatgagagagatgccaggctcctttaaacaaccagctttgttgtgaactaacagagcaagaactcactcattatcatggtgagggcaccaagccattcatgaagggtccacctccatgaaacaaacacccactaagcccacttctaacactggaaatcgcatttcaacatgagatttggaggggacaaaacaaccaaaccatatcagatagccagttgtcccaacatcaattactagaaaacaattttttacccactcttgtacagtgccacctctgatacatatatgaagggctcattatatataggagggcctatttctagactccccattttgtactattggtttttcatcctgataatggttgtgtgtctttttcttctctttttcccaattcttctccgtctcctttcctttctcctattccctcctctccttccctcctcctttcccttcttcctctctcttgttctcctttctctccccttgccctcccccatcttaatctgtgtcactgtagatttatcaatagttagtttttccaatgaattggtttgccttttttgttcttttctattatgtatttcttttctgtttcattaatttctgatcttctactttctttgagtttattttgatgagttttttttctaatttcttgaactggatggttagctcctcagttaacttgcctttaagtgcatttaaagctataaattttttttcagatactgttttatttctatgccatatgccttttttattatcactatttaaaaatcatttttaacgtttataatgagtctactttgggctataggttatttagaagttcagtttataatttccaacacatgaggaatttctggctgtttttaattatttataacattattgcattgcggtccgggaatatgcattatgtaattacagtgtgttgaaattttttgcaacttgcattgtggcccagaaaaaaagtcaacttttgtaaatgttccatgtatgctataagaatacataatgtgaagttttcagttatggtgttctctccatgtccattaggtaaagtttgttaatctatgaaaatactctgtttctttactgattattctccttgtttgtttctattaagtattttaaaaattttcactgtatttgcacatttatctactgcttcttgtcattctgtcaatttttgctttatatactttgatcttatgttattaggttatatcttcctggtgaattgaaccacttttattttttaaataactctatttctaattatagttttttatcttacaatctactttgatattaatataactcccaatattctttggattagagtttgcatattatactgtttttatcctctttactttcagtctttctgcatctgtttgttttgttgaaactcttgaactgtatagttgaactttcaaatccaattaggtagcatttattttctaattggaacatttagtttggttccacttaaggtaaatagtggcatatttggatttaaatatttctaaaatttagaactcttaaaatctttttttgcttagtctttatattagcttatgttcatgcctgaatatttgagaaactccttcaaaaggaattgtttaggcattaaaacaggtttgccggttttggttctgattttgaaaaattgatcatcgtgtgatgttttttgtttttgtttctaagatggggtcttgctctattgcccaggccaaagtgcagtagtgcaatcatgactcattgcagccttgacctccagggcccaagtgatcctcctacttcagcctcctgcgtagctaggaccgcaggcatgtgccactatgtccagctcatttttataaattttttgtagagacgggaatctgggaatctccctatgttacccagtctggtcttgaactcctggcttcaagtgatcctcctgcctcagcctccagagtgcagggattataggcatgagccgccatgcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagtttattgattgtcccccagaaaagctttgctgtatcttttttttttttctctgatgcattttgattcggagaatgactgacaatgcaagttaaggtttagtgccatatagtgtgtccaaatgtaaacttaaagcagcctgtattagtcccttctcatgatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacacttttaaagaaccagatctcatgagtactctataatgagatagcaccaagtggatggtgctaaacctttcatgtaggctccacaccatgatccagttacctccctccaggccccgcctccaacattggggattacaatgcaacatgagatttgggtgaggatacagatccaaaccatattacaaccatactgatggattgtaaactacagtttttaacctgcttctattaattagaggggtaaaggttgtaattttttattaatgtttatctcatgtaagtggttttatttataagcattcttttaaaaatctttttggcttggtgcagtggacagtgttgggtgggcctggacaacgttgtaagacctatctctacaaaaaaagaaattaaaaaattagccaggcatggtggcacacacgtgtgtattccctgctattggggaggctgaggtgagaggatcacttgagctagggggtcgaagcttcagtgagctatgatcatgccactgtactacagcctggacgttggagtgagaccctgtctctaaaataataaatacaaataaaaaatcttttcattatggaagaaattttaaaacatggaaacatatggagaagaatattgtgtaccttttcatcctggtcacttactttaattaattatcaattcatagccaattttgtttcatttctactccctcaattatgttgtaatctgaaacattgtgtcatttatataggtaggtagatatacatgtatattgtgtatttctaaaagattaagattcttttaaaggtcattattttaaaatatgaataattccttaaaatcaaatatcttgtgtttcccatttccccaattgtttcttaaaaaattgtattgctgtatcttttaagtctttttaaaaaaaattctgtaggtttccctctctccctttttccttactaaattgtatttgttgaagaaaacaggtcatttgtttcctagtttggttttttcctgattacatttttgagctataatttaacatgtttctctgctcctgtattttctataagttggtagatttaaaggcaaaaaattgtttaaaatttatttttattgttttaaaatttaagtacttctaatattgtagatttctcagatcattactgttacaaggggcggcttaaaggtagaactcttaaaatattattatcatctattctgccttcctggtttgtagatacagagacatcccagagaggttgtgatttatccagatttccacatcaagttgagattacagtggagggtgcgttcgaaagtaaaaataacttctccttttgaattttgatggcttcatgtgtgctacttgtgattttggttctttagaattcatcctgagcatttttccagagctatgcctaggaattcttgaatttgtcttctgctctctctctatctgggctccaccctgactgtaattcagtttgttaatatggtaataaaaagtctctatcaaagtcctcttatgtgtcaaagtcctcttttgccacatcttccagtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattatatagatatatattatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaattatatatttagaaaaattatatggtggtaaaacatataaaagaaccacacactcccaaatttacattgagctaatttagtacagttagcctttgtcaaagctttccttgtttaaaaaaactattggctcagtgtgcaggaaggagcataggagaaaaaattgccaagaatatttgaaaaatacagaaaataaagaaaaaaatcacctactatcctatcaaaaattttaatagctagaatcaggataagatagaatattcctgtggcagtaattctagtctatattcctttcctggaaccctgtctcccaaatttcaggtgagattttataagaagctctgtttatctgagatttaaaatataaaaacttgatttaacctatacagttttttaaaaagaccctaaataagtaaaatttagtactccacaaattgaagagaatttctctcttctctttactgccctctgagttttctctttccttctctcacctccaattttcatgtaaacactttcagttcgagtggaccttagagattgtctcattcaatactttaggaaaacaaattttatagaacccttgagttctgtggaattgcttctaatgaacaacaccttttgttgttgttgttgtttagtgacactgtgtaacaggcatttcaggaggagaatctcccagtctagaggaatcctctcagaggtagctataaaatattgaactctgatcttcaataagcattgtgcggtttttgtttttgtttttaatgacagttttaaacaagaaagttgctttatttctgaacttcataaaaatttctattaaagagacaatttctgaattttataacaatttctagaacagttgagtacctcactttgagacacatttttgctaaaagttaaaaacacaaaacccttatgagataaaataggaagctagtagagataggaaagtcctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaactcttcagttattcggtttttaaatcctcaatgaaaggctgctgtattatagagtattttttttttatttttaatagacttagaaccaagtttcttgagaaacctttggcatattgtagtttttttatggctatgactcacatgacattactgtataaaactagtacattctctcgtaaaaccacacaaacttactagagtgctgctctcatttttctacattagaaatgaaaaagggcattgtctgcattcaaaatttcctttttacatctctgtattactttttcccctttatatttatcttaaaaccaaaagaaataatgtttctattgttttactgtagttaccactgatgctaccgaagctgtattgtgagtgtttcaaaattctcaaaccagttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacaatattcccctgagggaattacataaaagaggtaatactatccccttgctgtgaattctctgttggtatgttttgcatgcggctgggcggtcctctagcttaaactggttctcgtttgtcctttaaatactgcagtacgttgtttagttgccctgggttgttagtaaggggaaaatgcaaccttctgaatggttgtgtagccatccctgattgttttctctgtgcagattagtactgcttcagatcacgtcgggctccgactccatcttctgcatgaaaatcttctttctaactctgaaaatgaattaatctgcttttacagccaactaaagtcgtgttggttggcatctaaaaagtaatgtttttcttccttcagaaaacttacatttcctttaatttacacagagaaatcaggtgcctatgtaccattatattttagctgctgccaattaccatgtagattttacaccacaaagtaaatttatagcaaaagctttacctacattttagaacattttaaaatgatagtaaagatgaataatttctatattaatactttttatttaatatgtatttcggctgagtaacatactacattgtcttccacaggtatcttgtgaaatttgatatgataaaacacatttgactaaatgtcagaaaaaataatattggtttgtgaaaagcagaagagcacccagcatgcctgtaaatcttttggcaggcacttcctcagtctccttaaaattaattgcatgttaattactaccctttttttcatttttgtttaattgcttattcgaaaaacagactggtcgacatttgttgtcctagaaaaaaattgaacttcaagaaaaatctcttagcttatgtgacttcatttttgagccacattagtttgaattactgcatgatattataaactcaccttatgatttaacccaaacttttatttgtaagtatataaggaagtaataatgtttttctaatataattagcctgctttatttaaaatatactttgtgttctgataacactttttttttagtattaagttccactataatttaaacattataatgtattcaacaaatgtctgttggttgcattgtgtctgctacacactattttagggtctgaacagttgtagcattatttatcttgcagtattctgtagttagtaaaaacttgctttttacattttgagaaaagctgtgtaaggatcatgttacatacattgtgctttctcttacagagttaccttcttaataaaattttgatatatgtgtatatgtatatgttagaacatttggaagaaatatctaaaagcataaagaagaaaataatttcttgtaatcacaccacccagagctttttaaattttttttcttaatgttacgatcataaattcttctatttcctatgttctgattatcagttttctggtaaggagttctttaaacaggaagcaaggtgaatgaatagtgactgttcaaatgtcacattatttgctaatcagtaattaaactgtaaaacaagacagactgtattttcctcatgctattacaacatttggttgttaatgatgatagatcagaatacctgggcttcagaaatttaaattccttttgtgaagcttaacagtctttgacagaacttacttatggactgtcttagtgtaaaatatgcaaataataagaaataagtcaaaacttatgtgagagtaggcatggttactgatattacctaaacgtaagctttttatttctattatactttcataaataatcctttaagaatcttgcttaggatctaaatcagtcccactcttggcagctcaaataggttctttatcccttgatgagacttattctattaatataagtcattgttatttgaaagtaacattgtgtatgtgtagtagagataagtcagttattaggctttcgtgactgtactgtattacctcaaacatactgtagtatcctagtgtctatgcgtaagatgttattttttgtccataatttatgacctgttgtagccatgggtcaacacaatggaattgatggagacaggcagctaacaaatcgaaaaaactgaatcagcttccctgtgaggaagaacaaaactataatgattaaaattgatcttcagcctgatagtgaagaggcagataaagtataaaattgtgaaggatatcaataaagtaaacatggatctgtttagtaaatccctgagtgctatagccaaggattacctttgttgagtaaattgaatttaatactacttttcaaggcgagatggtaaatggtgaagcttcctatttaagtaaataatgtcaagtctggaagtataagtagattcaaattagaattagtttgatatactattgatagattagaaattaagatgacatttcagaaatagccatctttaggggtagatttcctatatagaaacaatcaagctctctcaaaatgtctcttccttttttatcaggaaaaaagacttggcttatctggactgttagttttacactttttcttcttaatttgttcaagatgtttaagtagttttagaggtcaaatttctttcttctaccaaccctttataatggatttgatcttttgggcctgagcctccatttactccatgaggggcctttaacaattatttaaatatttaattgtttcattcagagtgagcatatatgtgtgtgtgtgtgtgtgtgtgtatatatatgtgtgtgtgtgcgtatatgtgtatatatatatatacatatacacacacatatggcactcctaggtgctgtggagaattataaaaatagtaatattaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcaccctccttggtacctgggactgcaggcttgcaacaccttgcctggctaatttaaaaaacaaaattttttttttttttagggagagtctcactatgttgtccaggctggtctccaactcctgggctcaagcaaccctcctgccttggcctcccaagtagctgagattacaggtgcgagccactgtgcctggcttgttctaagtgctttatgtgtatgaaattatttaaatcctcatcacaagtttatgaagtaggtactgttataatccccattttctagttgacaagactgaggtaaggaattgttaaggaaaagtcagaattccatccagatatttggctcatactttaatcatgaggctaaactgcttctctctacacgtatcttcatagtaacttgtgttttaagtctggtagaagcataagaagtttaaacacagacagaatcctgtggaagttagtaaatttctagtgaacgatagaaatgatagaaatctcttcttcccccaaagtcccaagaacagattagtctgcttttgacaagtgttatcaaagtagactgttctcacatacacaggggactcaatagggcattcctggtggatataataaaatgagtaaatgcgataacaggaggaaatgcctagtgtgttgctcttggattagttttgatacaacaaaggcagctttgttgtgagtcagtagagagggtagtgtagaaaggtggaagttggaagagtggcagatcctagaggactaatgatgggcttaaaccacaaaaagtgtcgctttgccattgaaataaaagtttggggtcttattttttcaagtttctccctgaaattatttcttgacattcattagctcagcagtgtatctaaataaagcttttttgggtttctattataatagaggtttgttcctttttcttccctttgaaaagtatcattttttgcacattatttgaaaatccaggtgttatatgatattcttattgccagagggacattctgcaggctctttgtaaaatgattttaggattcagatacttattatatttttattggccctaatattttatccaactagaaaattaaacctcttcttaaaaattaatccatctaagtgtctgtaaattaaaggaacaactaaagattctttatttggtgtcagaaactccttgtttctacaacagtagtataaaacaaagcctgtttttaaatgtacttttcccacagtatctgaatttcaaatcttcaataaaatctggttcatattactacctctagcttgattttctaaaaatagctgacactttagtatggttaattttatgccatctcatggcttgtcagaaatgctttgtatcaagatttccgagtgtgaacagatttcctgccgcattgattaagtttgtaattttggctattttcccagcatcgaggtttctgctttgcgtttatgcaggagactggtagtttaaattgaactttaaggttttgtttcttgtttttaagttaacatatgtttaatttctagtttctttgtagccctttgcaactttaattaggtcataaaatggatttactctagtttctctaacaaattttataaatttatgaaatatgaaatttagcaaattttataaacctttttattcatgtattgtacagctcatcatatttgcagacataataattgaatgtggaacttgtttccaattacacagatgtcttaatatccaccttatcatctctaactaaggatgtggctttttattttgaggtggcaacagaacagaaaagaaaacagtgaattgagtaatgggcttagtattgctgctgcctggttgtgtatctttggtaaacttctttgagatttggcattaacttgcaagtctttgcagtttagacagttaaatatgactgaatggctgaacaaattttaatagcgtatgcttcttttttgctatttatttacccagtagacatttaattgaccccctgctaaatgtgaggcactattcttgccattaccttttatctttgatttggagtctgctaacactctggaacttccactatcaacttagaacgtttactttcccatcccttaccaggatggccatttcttatcagtagggtcacagagagagaaaaaaaaaaaccatctggggctagacttcctgctcttaacatacagaagcaaataggttgtgaaggaatacatagtattttggatttctgcctcttccttccataatttttttaaaaaggttcatatgttttatgtgtgtcttatgtaacagtaatctgcattatgaacttaaatgacgaggatcaccatttcacatctttggagattgatcacagaggtaataagtaactctttttaaataactatatgcatcatttttcatgtaaaactattatttggataaacccctttgagaaaaggcttaggctcctgccagtgtcactgtgatatttactaataagctcagtttaaggcgcagcaattaaggttgtgttgtttttttttttttaagttcagttcagcaaatatatgtggaaagcttgtgggtaaaattatatttgtatttttgggaaagcagacaattttattaatgcctatatttttctagttcagtgtttgtcaaacttcaagttttaacatgttgatcatgaaaccagttgacttgtgaccagtattttaaaaggaaagattaaaaaaacaaaataaaatatcagtatataccaagtagtaagagtaagcattgtttactaaactttggttttatttaagtacatatctatatactatgtcagtgagaaacatttctccacttcatgtttgaaaaacatttcaaaagctaagaaaaagtttgaaaacctgtttgtaagtacacctggggtaaaggtacaccctgtggcataagatgtcgggaacaactgagggtaagaatggggatgcattactatcgtaaacttctgctaaagcataaggatgtgagtgctgggagcaaagcagtgctcaccacttctgcaattttctattgcagcattttaaataatatgggaaaaagtggactgcaaccaaaggcaaagagggatggtgatggtgaagggtaagattgtatttattgtccaaaggctaagtgcatatacatatgtgtttgggagaaggcatcacgtaatagttcttaacctactctgagagaaggttgtccacatttcttaaagtatacatgtaaaccaacaatgaaattattttagtgacttgagaatcaaagtgctagagtttgaatccctgttctactacttgctagcggtgtgaccttgggcctgtttaactcttgacaccttgttttccaaatttataaagtggagataataatatctgtcacattgtgttgttgtgaggattatatgaactaatatatgtaatgtcctgagaacaatgtctggtacacattaagttaattaaaattagctgttcttactgttattattagacatgagctagataacagtggcctctacatgggaaagattattttaattctgatgtagttcagtttatctattttttttatttttgtcccttttgcattgatgtcatatctaaaaaacctgcctaactcaggatcacaaaaatttactcctgtattttataattttagctctttagatctaggatccatttttagctaatttttatatatggtgtgaggtaggggtacggtttcattcttttgcacgtgaatagccagttgtcccagcatcatttattcaaaagactattctttcctcactagaaaaaatatttctttaaagaataatgaatccttttttttttctttttaaccgctgttactcagttggaaaaagaataatgaataattttaagtaattttcctacaggtaaatttaagtctttatgtttagattacacatattaggaaataatggatttgtattccataggtatgcttgatctttataaagttccctgtctctggaaaaactaaaataaggcaaaacaatcttcttagtagagttatttttacaagaaagttgcaagccagttttagttcatcgattggataatttttcctgcttgctggaggtatttcagtattggtaatacctgaactatgagatgcatgaatgatgcattttaggaatttgtttctgtgtccataccaggcataatgaattaagttatctgttaaaaatacaggatttttgctcaatatacagttgtagaagaactcattgtccaaatttttaagacttttttttctttttttttttgagatggatctcgctctgtcgcccaggttggagtgcagtggcacaacctccactcactgcaacctccacctccagggttcaagtgattttgctgcctcagcttcccgagtagctgggactacaggcatatgccactatgcccgcctgattttttttagtagagatggggtttccccatattggccaggctgctcttgaactcctgacctcgtgatccacctgcctcagcctcccaaagttttgagattacaggtgtgagccaccgcgcccggccagacatttttttttttttttttttttttgctgtctttgtcatattgttagtcttttggttaagcgatattataacttagtcatatgagtaatataatgcaacatgctgaattgtgtgtgtgagagggggttgttttttgtttgttatttgttttttaaatagagatgagatctcactgtgtttcccaggctcccttgaactcctgggctcagatgatatagcctcctgccacagcgtcctgattagctgggactacaggtgtgcaccactacacgtggctttcctgatgaaattttaaatacccaaatatttgagcagaaataatagcttgtgtttattgtttttctactatctgtcaagtatagtattaaatgttttacataatttgtctccagtccacatacaatactctagtagaagtgggtaacaaaaccaaggtactcaaagaggttaataagtaacttgcgctggatcacagaactaacgggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaaatcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatatagttatctgaagtcacagaaaatgtgcatgtgcatttaatgatgtgaaataatttttaggaagtatgaataaaaaaatcaacttttaagtgtggctagtatgatcttacctgtatctcacttatagaaaatataaaaggctgaagccagtcaccagtttaatagttctaacctcttgtttacttgattcccttttttctcctccccagcaatcctcatatagttaggtaaagttggttcttcatcaggcttgttgcagaaacccctaagcctttttacttaaagctttttgaaacccagaaacccatcttttgaattcaaaagttttgactgttattagtctttttgtatgtttgttggccgcataaatgtctcctttttatgaacagagaagtgtctgttaatatactttgcccactttttgatggggttgtttgtttttttcttgtacatttgtttaagttccttgtagattctggatattagacctatgtcagatggatagattgcaaaagttttctcccattctgtaggttgcttgttcattctgatgatagtttcttttactgtgcagaagctctttagtttaattagatcctatttgtctgttttggcttttgtcgccattgcttttggtgtttcagtcatgaagtctttgccagtgcctatgtcctgaatggtattgcctaggttttcatggttttgggttttacatttaagcctcaaatcgatcttgagttaatttttgtataaggtgtaaggaaggggtccagttccagttttctgcatatggatagccagttttcccagcaccatttattaatattaaatagggaatcctttccccattacttgtttttgtcaagtttgctgaagatcagatgattgtagatgtgtggtgttatttctgaggtctttgttctgttccgttggtctgtatatgtgttttggtaccagtactatgctgttttggttactgagccttgtagtatagtttgaagtcaggtagtatgatgcctccagctttgttatttttgcttaggattgtcttggccatacgggctcttttttggttccatatgaaatttaaagtaggtttttctaattttgtgaggaaagtcaatggtagcttgatgggaatagcgttgaatctataaattacttcgggcagtatggccattttcatgatattgattcttcctatccatgagcatggaatgtttttccatttgtttgtgtcgtttcttatttccttgggcagtggtttgtagttctccttgaacaggtccttcacgtctcttttaagttgtactcatcatcactgatcattagagaaatgaaaatcaaaaccacaatgagatgtcatctcatgccagtcaaatggtgattattataaaaagtcaaaaaagaatagatgtgggtaaggctgtggagaaataggaatgcttttacactgttggtgggagtgtaaattagttcaaccattgtggaagacagtatggcgattcctcaaggatctagaaccagaaataccatttgacccagcagtcccattactgggtgtatacccaaaggattataaatcattctgctataaagacacatgcacacgtatgtttattatagcactatttacaatagcaaagacttgaaaccaacccaaaaagccatcaatggtagactggataaagaaaatgtggcacatatataccatggaatactatgcagccataaaaaagaatgagatcgtgtcctttgcagggacatggatgaagctggaagccatcattctcagcaaactaacacagaaatagaaagccaaacactgcatgttctcacttataagtgggagttgaacaatgagagcacatggacacagggaggggaacatcacacaccgaggcctgttggagggtgggggacaaggggagggagagcattaggacaaatacataatgcatttggggtttaaaacctaaacgatgggttggtaagtgcagcaaaccaccatggcacatgtgcacctatgtaacaaacctgcacattctgaacatgtatcccagaacttaaatttaaaaaaaaagaatttttctcctctgtgggtttcagaagcctacatttgaaactgggatactgtaatatcgaatcgtgttctccatgctctgctgtgtatttcttttcctatggcaatggatgtctctgactgaattggtgtggggaaggtgtgtggaggggtcaagaaaatagcatggactaaggaacttgcttagtctttcctggaggtgttccactacagctctactactgtcttcacaggtaagtgagaactgcatatgctttgagaaatggctgatccaaggcaaatcctgtcattttaggttaataaaatctaactgtgagcacagtggctcacgcctgtaatcccgacactttgggaggccgaggcgggcagatcacgaggtcaggagattgagaccatcctggctaacaccgtgaaaccccgtctctactaaaaataaaaaaaaattagccgggcgtggtggtgggcgcctgtagtcccagctactcgggaggctgaggcaggagaatggcctgaacccgggaggcagagcttgcagtgagccgagatcgcgccactgcactccagcctgggtgacagagcgagtctccatctcaaaataaatgatagatagatagatagatagatagatagatagatagatagatagatagataaaatgaggatctgggactacagacgtgcaccaccacacccagataatttttgtatttttaatgaagtcggggattcaccatgttagccagtttagtctcaaacccctggtctcaagtgagctgcctgcctcagcctcccgaagtgctgggattacaggtgtgagtcaccacgcccagcctttgatatattattataggaaaaaagaggagatgtactttatgtagaagagaactttaatttatgctgtgacggtacctaaaagatacatcctttattcatgcgtaagatgaaatcgagaggtgaaattggatatactgttgcttttaaaaaattttaacatatatgtaattttttgtacttatctcattttagcctatataagttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaccttgtgatccacgtgccttagcctcccaaagtgctgggattacaagcgggagccaccgcgcccggctgtaagttatatcttacacaaatctaggtttcattcagagaattatatgcaaagaaacagtgcaataggattattttaaagccattgttattgttagaaaacataatacctttaaaattccttttcacattagaaatatagtggcttctccccagtttaggatagaaattttccttttcttctccttctttatactattcagatttgcatgtttgacagaacaaattataagagaaaatatttgaaatgtcacatactaaagtaaatgtttgaatgtttgaaaattttctggttttcagagattttgaattgctgaatcgttgtgtaaattaagatgttgagtagtttccacagagtaattatttgaaagtcactgaaagcaagacacatgcctaatgtaaatgtttattgcactactgtacctttttctacctcataaaaatgagaatagcagtctgtacttttccacttcgtcattcgtaagtctttgcagaaattcatattttgtttgcttattatcttcacgctgtaaatagcttgaaaattctttaagtggggctagcgatgtattatggatacatgttaagtggtatagaaatttcacttttttttttttgcataaagagtaacaagaccagtagtccatatttcttcagctctacccagagaagggcaatgtaggagggaaaatgaagtttgcaaaatatttcatagtaggctttttcttaaagtaacttcagacttacagaagtttaaaaatagtacaaagaatcccatatacctgtcaccccaattcctgaaatattaatattttaccacatttgttcattatgtctgtattctccaagtacgatatatgccattatatgtaatatgtagcattttatatagacatagggcatgtatgcactatatatttttttctgagccacataaagagtaaaacgcagacatgacgtgcttttactcctaaatacttcagtgtgtgtattccctcaagaaagggcattttcttctgtatagctaccgtacacttctacacttttcaaaatcagaacatttacattgataccatactatgacatgatctgcagaccattttccaatatgccagttgtcccactgtgtcctttagtacaaaagaaaaaagttttttttcctggtctaggagctaatcctggagcacatgttacatcctgttgttttaatctagaaccgttcctcagttctttatctttcataaccttgacatttttggagagtacaatccatatattttgcagaatttcccttagtttgggtgtgtctggtttttccttataagattcattttatgcatttctggccagagtaccacagaagtactgtatatcttaccagaaagcctaagtggcatttgcattttctaaatgatcaattttaatattatatggaaagcagagtcagagattctcacatatgtcaagatattataagtattcctgttatatttattctccaattgctttttctcaagaaaatgtgtggcctttcagctagcttttcaaagtggaagttactacataacattaggatgggagggtggggaagagctttattaaagctttaagattgagcttttgagtatgtgttgtatgtaaatgaaagtgggcattgatgcagggattgggcctttaaacctttggccaagaatggtatcaattattattattattattttttggagtacttctgctaaaacactgaaatcagtgtgccactctccttttagaagttttacacctttccaaggtacacttttttttttggagacgagttttgctctgtcgcccaggctggagtgcattggcgcaatcacagcccacttcagcctctgtttcccagactccagcagtccttccacttcagcctcccgagtagctgggattacaggtgcacaccaccatgcccagctagtttttgtagagatggggttttgccatgttgcccaggctggtctccaactcctgagctcaatctatccgtcctcctcagcctgccaaagtactgggattacaggcgtgggccaccactcccggcttccaaggcaggcatttaaatgtaataaatagggagataagcaagaaccctgttggacctggtagaagcaaacatttattagtactattacgttgtttaaaatattagcgccttctatattcatgtcctcccagaattatcaaaaaacctactctatagtttatttggcttatatctcaggagtaataaaattagttaatagtattggcatcgtggttctttgtgtattcctcccttatcccaccccaagttgatttcacatgatctcttgatctagtctaagaatgtttatagtgattacgagaagttcagattctggctttaacatatataattgttttttaatctgtaaaccaaagagaatgagtttgtttaaactagaaagatggcaagagtagtctgggaattttgttccattccttaaaagtcctataataaaataaacatatcttgtgttttatttttacaatttttttaaacattagtacagagtgccacttcttatattctatatcaaataatgagctacattttcaataataacctctgagtaatttttggcattaaaatctgcattacaaaataatttgaggatataatttataatcacttatgctaaaatcacctatttgaaattatgtatgaggttttcaaagtttatagtgctttggaaaaaatttaaatgtttctttgtttatgtatctttattataagctgtagcatatatcatgtagttgtcaaggatgctgatagatacttaatatttaaaggagacttgtctaaagttagctgtccaggactagaatctgggccttttggtaacagttcattgctctatttacttaaatgatgattggattcgttagaatttctctattttcatagctgtctctatggttctatgaaaatactgtgtgtgtgcttatacatatatgtatacctgtaagtacaaagtagaaaatgaaagttcattttctgcttttgacaattgtaatccccagagataaccgttattaatatgttgtctcatgtttggtcatactgttttctctgtattctgtgtattactgtataaattttacacagtaatttgcatattaaaaatgctggtctacacctggcccttttttaaaaactgcaatttattatggccaattttttataccagtatatattgatcaaccttattctttttaactgctgcatttcattcattaccaatagatgagacatttccattggtttgaatttttcagtattacagataatggttcaattaaatatttaagcttttgtgcacttgtagaattaattcctagacatagaacccttatattttgataggtatttccaaatttcttcccaaaatgtttgtatctctttacttccactctcaggtctaataattttcacttggattatcatatttcttacccagcctgttttttacactctaaactctttttcttttctttttttttttgagacagcatcttgctcttggcccggttgaaatgcagtggcacgacgaccaacctgggctcaagcaattctctcaacttagcctactgagtagctgggactacagacacatatcaccatgcccagcatttttttttttttttttttgtatttttagtagagatgaggttttgccatgttgcccaagctggtctcaaattcctgagctcaagcaatccacccatctcagcctcccaaaatgctgggattacaagcgtgagccactgcacctggcccaaaagctctttttctaatagcaatataaattgtcttttacagactatactcatatatgtttcttctttcagaaataggtgttaagtgtatctaacatggaatgtatagctataattctcattgtgaaaccatagcctaatttatttcatattacaatttaaaattcatattttttaggaagttttcttagattaatccgcctagttccaggtgctacagtcccaagatttctttctttttaacaaattaaatataggtaacatgactagaattgtagtcaaagaatattggaaccttggaacttcagtatttgaactttattttgaaatataatttgttatattataaaaatattataatatattgcacctggaagttaggggcagttttttttaattctctttgtatctgctacactgtaaagtgctatttatgtaaaaaattcttaatagaagtcttcagttgtaaagtctgctgtacagactttagatcagggattggcaaactatgagccatgtgccaaatcctgcccttcacctgttttgtaaataaagttttatcagaacacattcagactcattcatgaacatattgtctatgatttattttctgctactatggcagaattgagttgttgcaactgtgtggcatccaaagcctaaaatatttactctctggctctttgccaacccgttttagattatgagcactttggcattattatgtttttgttttctttctatagcacacagtaagatgttctgcccacattgtgcataatttatgggtttattcaaggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttgcatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgtttgtgtccctgggtacttgagattagggagtggtgatgactcttaatgagcatgctgccttcaagcatctgtttaacaaagcacatcttgcaccgcccttaatccctttaaccctgagttgacatagcacatgtttcagagagcagggggttgggggtaaggttatggattaacagcatcccaaggcagaagaatttttcttagtacagaacaaaatggagtctcctgtgtctacttctttctacacagacacagtaacaatctgatctctcttttccccatatttccccttttctatttgacaaaactgccatcctcaccatggcccgttctcaatgagctgttgggtacacctcccagacagggtggcggccaggcagaggggctcctcacttcccacactgggcggccgggcggaggcgccccccacctcccagacggggcggctgccgggcgggggcgccccccacctcccagactgggtggccgggcggagaagctcctcacttcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcacttcctagacgggatggcggcggggaagaggcgctcctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacatactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaatgtctacatttcatatgtggtacatgtttttttctttttctatgtttaatttttttagtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaatggtttactgttttttttaaaaatggctttaacatataaaagtacaacttatggatcctttttgtttgtggtcgtgacttactgataatgtaatccaaaatacattttttattttgtatttatttatttatttttgagacggagtctcagtcttctgcccatgctggagtatagtggtgtgatattggctcactgcaccctccgcctcctggattcaagcgatgctcctgcctcagcctcctgagtagctgagactacaaacgtacgccaccatgcctggctagtttttatacaaaatacgttttttaaaaaacaattttttttttggaggtcgggggaccgtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcaaaaggccctatataattttggtgttggaaatttacttgtcaatgaaaatgactatttacacaaattataagcttccatattaatatatatgtgtgtgaacctgaaattcaaattttattatattgtttatgaaaggtacagcctctgagattcatcagatggtatttacctttagggcatatctaaaaataaaatacagtacatgaaatccagtgctttaatccagtgattcttaaactttttgctctcagatcccctttaaactcttaaaagatattgaagagctccaaggaggctttgtttacgtggtttttatcaatggatatttaccatattagacactgaaactgaggattttaaaaaaaaataattcatttaaaaataacagtaacaaaacccattacatgttgacataaataacatttttacgaaactatattttcaaaaattagtgagagaatgacattgtgctacatttgttataaatctcattattgtctggcttaataaaacactgctggattctcatatctgcttttgcagtcaatatgttgtatgttgtttttatggaagtatgtgaagaaattcaacctcatacacagataatatagttggaaaagctatgagtattttaatagtcttttaagattattgcaaatattcttctttgatactacactaaagtgacaattgttagtttcttaaagattagttgtaatgtgtactttgaaactgcatcaatgaactttgtcttctgttacattaaaatccattgattttgaatatatgattttgtaacattatgcagtgatcatttagaaaatattgattcactgatttatgtggatcttttaaatgttgacacttatataatataatacaatattttaaaaatcacatttgttaattttacctttgatctattcagaaaagactctaagtattgggaacctatcatcctcacagtgatagatacaagtttcctaaaattctgatttttactggagagctcaaattctatcattggaaacaaatacacatttatttaacttaaaaatgacaggattacttggtttcattattgagaaaatacctgtcaaattcccaagtctggaaaaccatagtttgatgtcactctttcaagtaaaaatggcattccatgtaagaagtgtctagtttattatgcaactcaaataaattacgcaagtgcttttctttaggacataacttcatacatacttccacaagcagcagatgtgtgtagttatgcatagttccttatgcatggttcttatttcatcacacaaaatattaaaaagactcagtgattgagacgtagcagtttttactgcttcatcaaagatgctcttatttgaaactggcataatatgatttatttatttgattttactgggaagcatggcagtcaagaatgtaatgactgccagtacatttgagtgccactgcttgatttttgctatggagtcagcaattttgccactggttttgcattttcagtaaaaatgtcaacacagtgaaaaaggcacataatgtcttgtattattttgtaaacagttttatcttgcagaccccttgaaaaggtctcggggatcctccaaggtgccagtagaccgtactttgaaaatcactattttaatccaaagtgcctagatcagacacactataaatcctgtgtcttgtatgatcattaggtaaatacatttgtacttagaagtatacattcagagacattaacagtattcaggttgggatttaagtatattttaaagtgtggtacctagagagtatccatgacactatgttcataaaattttagagaaaactgagatcaaaggaaaccaaaacaggctggtcatagtggctcatgcctgtaatcccagtgctttggaaggttgaggcagaggatcgctggatcccaggagtttgagaccagcctgggcaaatatggagactatctctacacaacaaaacaaaaattagctgggtatagtgtcttgcgcctatagtcctagctactcggaaagctgaggtgggaggatcccttgagcctggaagttctaagttacagtgaattatgattgcaccactgccctccaacctgggtgaaacagcaagaccctgtcaccctccaaaacaaacaaaaaacacttttttctctgagtatgtaaatggttagtgtacagtccttgaaaacattgcaaatagtatagcaatatatgaagtagccagtatgtgtcctagctaattttatcaatcatctcttcctagaccaatcaaatatttttcaatattttgatccatgcttatatgaacaagattttttaaagctggaaaattccacacatttatatacttactattgttcttaaaattaattttttttttttttttttaagcagagtcttgctcttttgcccaggctgaagttcagtggtgcgatctcgactccctgcaacctctgccttccaggctcaagcagctctcgtgcttcagcaccccaagtaactgggattacaggcatacgccaccacactggctaatttttgtagtttaagtagagatgtggtttcgccatgttggccaggctggtctcaaactcccggcctcaagtgatccacctgtctcagcctcccaaaatgttgggattacaggtgggagccactgcgcccggcctacattaaattttaaagcctttctatgtcagtgcatatacccaacctaattctttttttccgtgaacttttttgttatgcttgtagccttcctaccccagattatttcgaagcaaattgtcattctgtaatttcaaatattactatttcagtattttacaaaatggttgcagtttaattgttgttccttttttatttattagcttgcatatttctatagagagtttaccccacatcaaccatttggattacctgaagtaagggtggtacaggaaagggagaaatcttgaaatactaggttccttagcatcctcaaagttgaccaatgagattttttgcttgtttggttgtttttttctgtgtcttcatggactcatggatttaagtatatttgtggtttaatcatcactgttattattcttattgatgttcatgttattttagattagtgggagcttttttagtttgctatctgtgtccttcgtcatgtccttagataatcctaatcctaatcctgattcatcgtagacatttcccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccacggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatgaacatttaaatgatttccagattttaggaacggtgatgattgaactctctgtacatatatcttttttacttggtacactccatcaagcaactacttaagtgactgactatgatgctgtgcaagcagttatataaagaaaacagcagtgactcagcctgaaaacggcttaatattatcatgttttcttacacattatttttattgaggaaaagcaacatggagtttagtgattatttttgaaagaaataacctatttctaattctaaagaatggttaatatctgtgtttggttgcttatagggtagaaggggtaaaattgcctcattcaacttagaacttaccgtgtcattttagtggggcgttgtgacttcaaatagacccgattcttgaaatagactgggtccatgtcctttgttgggacatggatgaagctggaaaccatcattctcagcaaactgtcgcaaggacaaaaaaccaaacatcgcatgttctcactcataggtgggaattgaacaatgagaacacatggacacaggaaggggaacatcacacactggggactgttgtggggtcggggagtggggagggatagcattaggagatatacctaatgctaaatgacgagttaatggatgcagcacaccatcatggcacatgtatacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttcgccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaatatgggtttctaaagcaacagtcctagtacaacagaagagaggtgttgactagttagggatttaggtttagaagtacattcttagtaagagaggtgagacttaccttcttgtgttttagtatagtgagatctggatcaaatctattactcttattaatctcctaacttcctacactatatccagtagaggacacttttgccttacacagtaaagaaagagcctctggactctaccaatgggatcggagctctccaaacctgcatattaaaaggcctataagttttggggggtccctttgtccacatgattattctgtaatacattgtatttatggacatggtattattatacacagatcctgtcttttaaagaacattataatccacttaactgctaggaccagagaatgaccgataattcaaaccatattgtcttacagaagacatatataaaagatggttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggtaaagaaaatttttcaagcaatccttttttagttaacagaagtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaattaagttatcgattgaaaattagatttgtgaacctcctgccaagtagctgtcttttgaagatattttagtatcttttaaacattgtttttcagatcacaattaatttgaatgatgtaactttttaaaattccaaacaaaaatagcacttttattgtaaaaaataactctttacagtttataactaaaatttgaaaatcttaaatttatatgtagttcataaatgaccctttatttaggagtctcctgctttctacttgccttttaactagattgttctcgactcccaaaaaattgacttaatttttttaccatctccaacatgtttttataggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagaggtaagtcttgctttgtctcaagatgaattaataattgatatagcaaaatgtttccaattcatttaattatagaactaatcacatattagatgattacatacacatcaaatggatccaccctcaacacattgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacagcatttaaatgattgatttactatgatctacaaagaacattttagaacttaggatgttacatgtatattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgagatgtgttggtaacaagactttagggattaggaaaaagattaaatgtgctcagggttccttggtatatgtaggcattaatttttggactctacttaaatattttgttcatataaagtttttattattgtggaaataaaccaggagacttttacacattttactgaagtttcttttctttctttttttttttttttttttggccggggggatggagtctcactctgttgcccaggctggagcgcagtggcacgatctcggctccctgcaacctccgcttctggggtttaagcgattcttctacctcagcctcccgagtagctggtattacaggcgtgcgccaccatgcccagctaatttttgtatttttaatagcaacggggtttcaccacattggccaagctagtctcgaactcctgacctcaggtgatccacccgcctcaacctccccagtgctgggattacaggcgtgagccaccatgcctggccgtttactgaagtttcttatgacaagcatttgcattagaggtgcaatgtaaattaaattcatactctcgaactattttctttttagggtcctggttcttatatcatgaactacataatgtacatcttctgggccttgagttttgcctttcttgcagtttccctggtaaaggtatttgctccatatgcctgtggctctggaattccagaggtaagccaagtaatatttagtgtcattaaacattattatgatgcttatctttttgaccttagtgataataaaagttggcttttctggagggaggggatagtttgttcataatatgaaaaaaaaatttttttaagtataagctgatggtagacatcattgaaaaatattgttccccatagtcatttggtcatttactgtgaaggctgattttttttttctctcaccactaatttaacacatgactaggcaaattttcagactatttagttaaacatcaagagcctggaagaagtatcttgtgacctaatgttctttgacgggttagttgttactttgctgttatgaccctgaattttttttttttgagactgagtcttgtgctgtcgcccagactggagtgcagtggcgcaatctcagctcactgcaacctctgcgtcccaggctcaagcaattcttgtgtctcagcctcctgaggagttgcgattgcaggcacctgtcaccatgccctgctaatttttgcatttttttgtttgttttttttttttagtagagatggggtttcaccatgttggccaggctggtctcaaactcctaacctcaagtgatcacccgcctcagcctcccaaagtgctgggattacaggtgtgagccaccacacgtggctatgaccctgattttgattcattcactttttataattaccttttgattagataagttaattattcttgaatttggccattttatgctttgagaaagtagttaatcacagtgggtcaacagtacaaacttttgggttttatttttcatcacaataaagtagagttatacataggattgattgaacttgatttgaacttatctcttctcttttatttttctgtagttaaataagttaccaactttttcctaatacatttctttttaaaatggaattgtattgatctttaagtttgtattaagaatatctttcataaaaagcaatatcatgcagtatataacagttgttactcattcttgatacataaaaaactattgcacataattacagtactcagagaaaacataatattcttatttctaacataatgtccaaaatatatttaaaatattatgcttatttttacaacagaaatattcaaatttgccctttttttggttatgtaattataatccttataattaaggtctgtattcattttaacatggcctgatattttgattttgttcctgagatagtgttgccctctctcctttcttgggtagagaattagattataatatcaatttattatatgtagcataataggcaaagttttcgaaaaattaactgtaaatttttctgtagactgctaaaatttgcaaggttgtttttgtgcataaaacaagaaaataacttggattcgttacattctcatgtttcttaaaggacattaagctgccttaatctttgccttgtagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtaagtgtcttttgtagttaatttgactgaaaaatatatattatatagtatttatttaagtaaagaatttcttagtgtaaaaataataaattctgtattcagataaaaaattttgagatttgtgcttctgtttttcctgaataatctataacatctttctagaatccattcccagtgctgctcagttcgtcttacattttagagaagctttagatagacagctggtgtccattgggtttcagctgcatttcacgaagatcttcctgttatcactttaccttacatctttcctcttctgaagtgttttctaagcttagctttgtttttcactcttactttcaacattaagaggttgggaaatcttaatagctatgttttcctcctggaggcagtgtctggtgccagtgtaagtggtgtgtgatatgaaaaatgctatccagtgctatggggaagttctgagggcctttagaagctcttgaagtttaaatcagaaattcacattaaagagattacaggaaatccttttcatttgattgtttaaggcaatttcctttaccatttctttaggccagcctgagatcttctacaagaccttgaaaccttatatatattatggatttcctctgatgtttccatattgctctgggcattttcctgaatcctttatattagctctagactttgggagcccagtcccttcctattttccaaatctaaatctacagccctagatggtacagagatctttgagtttttaagatatgattttttgaaaaacatctcattaaatactggcagaaccttttcatcttgttgagttttttaatgtactgtaaccaaaaaagtagaatattttatcaaactgtttaatcttcaattgaaataattctagtacattttaatgttcgcattaaaatattgtccttgcattggacgtagatatcccaaaagtggaatacttcagattgtcgtagtttcatctctgaataattgtgattccagtactttataacaaaaatagctagcattattgattactttctgtgtatctggtactgtggcagatactttacttggattttaatacttaatttcacagtaatttagtaatatggccctgttatcctcatttagtgattagtaaactagggctgaaaacagctaactaacttgcccgagactacatacctagtaagtggtggaacgtaggttaaaattcatttttctttgacttcaaagtctgtggtcttacctacttacattactgcccttacgactatgtgggtatatatttgtgtgtgttcaaaacaaactcaaaaccatcctgtagcgtagcaagttagtggctaagatgaagctagagcatttgcctcctcaattcaattccattactttctgttgtacctttatattttttggtaagacttttacttattctaagttcaaaaaatgtaatttattagatgtttgagaaattaagtttacctaaattttaatgttcatactgtagtgattagttaatgtttaatacgttgttattctgtcaccttagtgtatatataaatggcaagaattcacggttagttgaaagcattaaggtcccatagttttgtgtagacaagaggggagagcgttgatatttttaaattaaatgcttcttagatacgtatgaaatggattaaaacatgtatatgagttatagatacctaggtgttagtttggttgtaaattcaggatcaggacattcaaataaatatgtttgctttcctcttagtggaggaaaaaaaaaagaagctaaatttgctccctttcctccccaaataagcagagtctacattttaatgccaacaatttgattaaaacaaatatttatttatttttaattcaccaaacttttataaagtatttactggtgccaggcactgttctaaagcactctgtatatatttactcagtccttaagagctaagtaatattatcacgtttccattttagagaaaactgaggcacatataggttaggttatctacccatagccatacagctagtaagtagcagagccatgatttcaacacagcagcctgactatggagttcatgatcttaaccatttacagcttaatttttattatttataatttctcttctggaaatgtaacaattgaccatttgaagaaatactttaggtagctttggatatttgctgtattaaagtagtgaaagtaatacagacacttggctgggcgcggtggctcacgcctataatcccagcattttggtaggttgaggcaggcagatcacctaaggtcaggaattcgagaccagtgttgccaacatggtgaaaccccgtctctactaaaaatacaaaaattagccgggcgtggtggcaggcgcctgtaatcccagctactcgggaggctgaggcaggagaatcacttgaacccaggaggtggaggttgcagtgagctgagacgacgccattgcactccagcctgagagacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttggatttttcttttcctttaatttttttgtagaggtgttggttggtgagactgtaacttgaggagctgttgtgtgtgctttcagaatgaggctctctagattgatagtattttagcagtatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgtcttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatgaatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggtaggtgaaaagaatacaacaattaaaattatatataattaccattacaaatatatttcacacatttcagttttataggtgatgtaataggtagagactttgttttcaaatttatttttctaaagttgttttccactcattcttaataaaaagtaaatgttattcatgctccatacctggaggaaactttttaaaaatttattaatgtatgaatgttagtaattatttaaaatctaactttgttgacatatttaaaagtaagaagatgtgaatttgacttaatagaggacatgtgaaacaatctatttccattggctaaattctgtatttttagtagagatggaatttcaccatgttggccaggctgtttttttgtggggtttttttgttttgttttgttttgtttttgtttttgagacggagtttcactcttgttgcccaggctggagtgcaatggcgcgatcttggctcactgcaacctccgcctccagggttcaagtgattctcctgcctcagcctcccaaagtagtttttgtttaaaaaattttaatcaattcctatgttgtgttttaaagtttttcccatgtgattatttctgatacagttagtgatgttaaagaaaataattttagtgacttcagtggattattttgtttttgttttcttaataggtgtttaagacttttctttttacataaaaatgtaaccaggaatttttttttaattttttttgacaaataataattgtttttgtttatggggtataatgtgatgtgtctatacatgtatacattgcggaataatcaaatcagagtgattagcaaatccctcaaatatttattatgtccttgtggtggtgagaacatttaaaatcctcttttagctattttgaaatatataatacatattattaactgtggtcatcttactgtgcaatagaacaccagaacttattcctcctctgtaagttcatacccgttgactaatgtctcccctttccctgttcacctccccaacccctagcctctggtaacccctattctactctctacttctatgaatttaactcttttagttcaagatgtttttaaatgtacttttttcttttagttgtttgtattctttttttttttttaatgtagaagaggcaaattaaatgcattataagttaacaggagttggtgatggtacatttatttttaactaccatgattgaattgaatgtgaaactcattttgaatataaaacagcactaggtattctattagtatttattagacatttatgatcaattgatactgtcaatttgtaatgatgatcaccatctccaaaaataataataacatcaatttttcttattacagtaaaatccattacatgtaaattctaactacagcaaaatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtttaattttaagtaatgaaaaagataattccttagcatatattgttgaccatgttatctgttgctatttaacaaattaccccccaaaacttagcagcttaaggtaactacttattttgttcttgatattgagtcaacgacttgggaagggctcaactgggcaatttttgcttgtggtctttcatatagttgttattagacatggcgagggctaatcatctcaaagcttctttttttcgtttcctttttaaaaaactgtttttgtggatacacagtagctatatatagttttggggtatatgaagtattttgatagaggcatggagtgcataataatctcagggtaaatggagtatccatcacctcaagcatttatcccttgtgttacaaacaatccaattacactcttaattatttttaagtgtacaattaaattattgaatatagttcaaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattccttggctcctggctgtctatttgcatcttcaaagccagcagtagctggtcaagtctttctcttgtctcatcaccctgacccaaactctgctaaatctcccttccacatttgaaaaacctttgtgattactttaggcccacgcagataaatcagaaaataatctcctttttcaaggtcagttgcttcgaaactttctttctgccaccttgattcctccttgccatgcaacgtaatgtaatcacaggttctgggaattaagttatggacatctttgatgagccattattctgcctcataccagtatagggtattagcttgaaaggacactgcagactcagttaaattactagatctataaatacatgcctttttccatcaagaaattaaggcagctgggtcttatgccctgggacattgcttcttttggatttataaaataacaaaatttgttgattaatggtctatcagtaaatataatttcttatgtgactatcagtgatatatatggggaagcacatatcagcttattcttgttctttaaattactacccctgtacttcatgtaatagtatttgctagtgatgatgtgcttttacagatgtaaattaatgtggaataacagctttgtttctacaaaattagagtggttttagtttttgaaataaggtctcttttctcttgtcctaagtctgtagtccactgagtatctagagttaaataatagaaaagcctggccaggcgcagtggctcacacctgtaatcccagctctttgggaggccgaggcgggcagatcacaatgtcaggagatcgagaccatcctggctaatgcggtgaaaccccgtctttactaaaaatacaaaaattagccaggcgtggtggcaggtgtctgtaatcccggctactcgagaggctgaggcaagagaatcacttaaacccaggaggtggaggttgcaatgagccaagatcacaccactgcactccagcccaggcaacagggcaagacactgtctcaaaaaataataataagaagaaaataataatagtaatagaaaagcctaaacattttacctttttttcttagggaatcaagttaaaagagctgttaaagctctttttcctacaataagtaagtgttgggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactgaacctggcctctttcagtagtctttaaatgatcttgcttatggtgcttcttatccctgtttattatccttattaaatttaatcaataaatatttttctctttttaattgattcatataaatagacttacctgagagatataggttcagttcagagcaccacaataaagtgaatatcataataaagcaagtcacataaaagtcttagtttcttagtgcatataaaagttctgtttacactatgctgtagtcttatgtgtacaatagcattatgtcttttaaaaaagtaatactttaatttaaaaatacttgattgctaaaaaatgctaatagtaatctgagtcttcagtgaattgtaatctgttttgcttctgtagggtcttgccttgatattggtggttgctagaggtaggactggctgtagcaattcttaaaataagataacagtgaaatttgccgcattgattgacactgcctttcatgaaagatttctctgtagcatgtgatgctgtttgataccattttacctacagtagaccttcttttcaaaattagagtcatcctctcaaaccctgctactgctttatcaactaagtttaaggaaaattcaaaatcttttgtccttttaacaatgttcacaacatctttaccaggactggattctacctcaagaaaccactttctttgctcatccataagaagtaactccttatacattcaagttttttaaatgagattctagcaattcagtcacatctttaggctacgcttatcattctagttctcttgctatttccaccactctgtagttacttcttcaactgaagtcttgaacccctcagagtcattcatgagagttggaatcaacttcttccaaactcctgttaatattgatattttgacctcctcccatgaaacgtgaatgttctggatggcatctagaatggtgactactttttgaacattttcaatttattttgcccggatcaatcagagaagttgttatcagtggtgggtttccaagttgtcaggggcgaaccatacagatcttcagcaacctcaactcttgccttctcagaggaaagaattctacggagggacataaggcagaaaaagagactgaggcaagttttagagcaggagtgaaagtttattattaaaaagctttagagtgggaatgaaaagaaattaaaatacacttgaaagagggccaagtgggcatcttggaagacaagtgccccatttgaccttggacttagggttttatatgttggcatacttctggcatcttgcatccctattccattgattcttcttttggggtgagttgcccacatgctcagtggcctgctagcacttgggaggggagtgtgcacagtgtatttactggagttgtatgcatgcttacctgaggtgtttgttgcttaccagccaaatgtccctaggaggtcatattcataaactccatgattttgcctctaaatgtgcatgcttgagcccactcacccaactcctgggatcttatcggaaagctgccgatcgctagtttcaggtgtttctatctattggaagatggcctttccctgatgctggctgcaaccaattattactttagagagagagcatgagagctgtctcaccatcatcacctgatggttgcctgacattcctggtggggttgggaggatgcctgtcctgccctgctcatgcctgactagctacctgctgtaacaaaagtactatctatggtagctgtagccataggaaatgcatttcttcagtaaaacttaaaagtcaaaattagtctttaaaacaacatgaatctccttgtacatctccatcagagctcttggaagaccaggtgcattattagtgatgagtaatgttttaaaaggaatctttttgtctgagcagtaggtctcaacagtgggcttaaaatagttagtaaaccatgctgtaaacagatatgctgttatccaggctttgttattccatttatagagcacagagagagtagattggcataatttaaggattacttaaaaaaaaagtctttgattactctcaaaaaaaagtcacgtctctcactttatatcaacagctaaaaatggccaggtattgtggctcacgcctgtaatctccatgctttgggaggccaaggcagaaggatcacttgaggtcaggagttagagactaacctgggcaacatagtaagacccatctctacaaaaaaaaaaaaaaaaaaaagaaagccaggtgtggtggtgcacgcctgtagtcccagctactcacgaggctgagtcggcaggatcacgcccagccaagagacgtgacttctgctttcagttgtacacttagagaccattgtagggttcttagttggactaatttcaatatcattgggtctcagggaatagggaagcctgagaagagggagagacaggggaacagccagttagtggagcagtcagaccacatacaacacttattaagttcactttcttctatgggcatggttcatggtgcagtaaaacaactgtaacaggaacatcaaagatcattaatcacagagcactgtaacatataataatagtgaaaattttcaaagtattgagagaattagcaaaatatgatacagagacacaaagtgaccacatgctgttggaaaagtagtgctgatggactagcttgatgcaaggatgtcataaacctcaatttgtgaaaactgcaacatgtgtgaagcacagtaacacaaagcatagtaaaacaagatatgtctgtatatcagtcaaaatattgggcaactctgataagtttgtccacttaacattgtaccacttaagatgaatagcatctaccatttccgtcatttgtaaatatataggaggacataatcacataatcttgaagtaaaagacagtgcttaaaactgaatcagttaagttttatgaaaaatacttcatattgtacttttaaaaatatatattttttaatttcaatagcttttgggttacaagtggttttggttacgtggatgaattctataatggtgaagtctaagattttactgcaactgtcacccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtaatatggctgtgtctgcctgtgtgtggatgtttgcaagtctgagagagccaagagaaagtgggacacattcttgcttaattggtgggcggattggttgagtaaaggagggtgccaggaggagatgttttaacagataagaaacagtagtactattagggtattatacagtaccggttttctgtcttacaacatttgttaatacaagaatttaatggcattagcatattgtaatataacttaatacactatggcagaagccatctaagtacaacataagcttaatttgaatcctgaccaaagatgtctttgattctttcatcgttaaggatcttggcttacctataacaactatagcataatacctaagattagcattgcaacagagtttcagagtaggtttactttggttctgaaatgatttattgttagccttagtaaaagatgtatttacccatgctccatcatctaaggtatatttgtaacaaaatgagaaaaggtaacttcattttaatgagaagaaaagcaaaatacctacattaagtacttgagtctatttaatgtctgttagggcaggaaaaaatggttattgcttttcatatttaaaatatcagctacactctggtgataatattaatggttgccattttgaccagttttgtttagtgaataaaaattatgtgattattgatctttaaaaatgtaatatcaattaaaaggaaaggacagactcattttcaccaaagtagcaagtatttattaaatgtccactttctttttagcattgtgctagatacagtgcataatacaaaaagaacatggacccaatctcgactctaatcaagttgaggagacaagatgaacactgagaatacaatagtgaggaatactaacaaatatatacaaggttaaaagagtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagttggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccctggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggactggattgataacagtgagaataccgagaaagggaccataggcagtgtgaacgcagctcactgcagcctcaaaccccagcccaaacgagcctcccacctcagcctcccaagtagctgggaccacagacatacaccaccatgcatgactactttttttagtttttacttttgtagagacagggtctcactgtattgcccaggctggtctcaaactccttgacttaagtgatcttcctgccttggcctcccaaagtgattacaggcatgagccacagtgcctggcccaaatagttttctgtgagtgaatattacttgcatcgttaatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttttaactgcctagtgcaaaaattctaataaaatgtaatgatgaggatcctgtccttcctgaccagtgggtgcttacttttttcaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttcatcagtctctttcatattagaataacactgttttgctttatcagtctttggggttagaattataatattaatttataatatctgatttaaagtgacaatcactgagatttttatttctgatcaaatgccaggttgaaaaagtataacgtatcagtcctgttgtgttttatgcagactttcctgaaaatactgtttaaaggtattagccatagtgtatttcttggagataaattaaactttctatagttctgtttctctaaaatttgtttttctctttaccttatagtcccgcagtattgatgaggagaccattaagacttaatatttttttgacacaatcttatatctcttcctccaacccctaaaaagtgactgaggataggtacatcaagccattgctttgttactccccaggttttagtgccagaccctgaatggaagtgtcaagcctttggcctgtctgaaaggtcattcctgtgagcatatcatctcccttccagcttacctctgtggccattgcaaaaggatttaaaaataatttttgtgccatttgaatggcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaaagaaaagaaaaaggaggtcagaatttcggtatttacatagaaatttaaggggaaaaggccaggcatgtttttaaagtgtggaaattaagaactattcattatcccactgattgtgtggatgtgttttttaaagttttgttactgtcttgagagagagaatattgagataggacataatgttggtttaagggaatgagggtactttctgtaggtgaggtgccaagccatgtcatcagaaatgttagtcacatgactttctaagcacaccttaaatgttttaccgtgtatgtttttgtaaagttttaaatttttaactgggaaaaacagacctgtatattaagttttatatatatatataaatttaaaattacatatatatgtttatatatgtaacttttatatgggagagatatatatttctatatcctctataaaaaaacatatctatatatgaaaattatgtacgtaaatgttaatttataattaattatataaatattaacataattacattatatatatagaaaacctagtgtacagatctgtatataaattaaaaatgtatgtgttatatatagttacatcatataatacatataattgatatatataatgataaatactttattgaaggatgaaaaaatttccatgctgtctcataaaataagatggttgacatatgctaaactagatagattctcctgtttcatactaaagcagaatgttgtaaaatattaaatccaaatgagatgtctcagattaaggccatttcaacaggaatgctgagactttaaaaaaaaaaaaagtctgaggctgggcgtggtggctcatgcctgtaatcccagcactttgggaagctgaagcaggtggatcacttgaggccaggagtttgagaccagcctggccaatgtggtgaaatcccgcctctactaaaatacaaaaaaaatacatgggtgtggtgacgcatgcctataattccagctacttgggaggctgaggcaggagaatcacttgaacctgggaggtggagattgcagtaagccccaccactgcactccagcctgggcgaagagcaaaaccctgtctcaaaaaaaaaaaaagcctgaattatatcagcaaatgaaaactgtaatgttgttctctgtttcagaggcccttgaatgaatagcactaaaaatattttttaaaaaatgaagaaaatgaaaattgtaatgttccttatttaaaaggcccttgaatgagtagcatcaaaaatatttttaaatgggaggccagggtgggaggtttgtttggcaccaggagatcaagaccagcttgggtaacatagcaagacctttgtctctaccaaaaaaaaaaaattgggtgtggtggtgccacctgtattcctagctactgggaacactgatgcaggaggatccctgggactctagagtccagagtgagaccctgtctctaaaacaaacaaacaaacaaaaactgtatttatgtaaaagtaatacttgttttttaaattttatttatttttaattgataaaaattgtatgtatgtttatgtgatgtatatattgtggaatggttaaatcaggctaattaactcagattttttgtgtgtgtggggagaatatctaaaatccctctccttagcagtttccaaatgaaatgaaagaataaaagtgatttatttttttgagacagcatctcaccctgtttctcaggctggaatgcagtggcacgatcttggcttacttgatcctcgacttccctggcatccggtgatcctcccacttcactctcctaattagctaggactacaggcatgcgccaccatgactggctaatttttgtatttcttgtataggcaaggttttgccatgttgcccaggctggtttcaagctcctgggctcaaacgatccacctgcctcagcctcctgaagtgctgggattacaagtgtgagccaccacacctggcgaaaagtgttatttttttaaatgacaaatttaagtcaaagagattgaatgttcacttctggtactttgtatataagagaaacattccattaaataattttttaaacatttctaaaattacatattttgtcattaaatgtttaaacaatcagtataatttcattgatacagtgtttgttattttgtcggtgtttaagattgataattggggttagttttaattcagaatgttattctatttaatgtcacacttcatgtctttttattttgtatatctattaatgaattattttagctatagttattactgttttagagatgaggtcttctatgttgcccagggtagacttgaactcctgggcttcagcaatcccctcctcaacctccggagcacatgagattagagacgtgtgccactgtatctggcctgctgtagttatttttaattcttttgtctttcaacttttatactagagttagaaatgatttacaaaccctattgcagttttagagcgttatgaatttgactatatatttcttataacaacttaacttcagttgcttacaaaaactacagagttttactcccccgtccacattttatactattgatgtcacactttacatctttttattttgtgaatccattaatgatacttctggtagtttttacactccactattcagttgtcagacaccattcagttgttagattgttatgagctaaaagcaacttaatgggtatttttcaaaaatcatttatgtcaattgctaatggacttcttttctatgccatgatcatgctttttttatttttgagacggagtttcactcttgttgcctgggctggagtgcaatggcgcggcctcagctcactgcaacctccgcctcctgggttcaagcgattctcctgcctcagctgggattacaggcatgtgccaccgtgccggctaattttgtatttttagtagagacagggtttcaccatgttggccaggctggtctcgaactcctgacctcagttgatctgcccaccttggcctcccaaagtgctgggattacagacgtgagccactgcgcctggcctgatcatgcttttaaggtggttgagtaagtactagttgctggggctttacttagtgccctcctactcaaatgtgttagaacatagttaagaaggctgtagtgttcaaaaggagtaaaaagcagtgcagtgtttgcagtaatatctgcttctcaatttaggactgatgcttattatggcttaaatgtttttgtagtaaaatttgtattcaaaaaatatatttttttttctttttgcgacagagtcttgctttgtcacccaggctggagtgtggtggtatgatcatggctgactgcagccctgaccttccgggctcaagtgatctttccacctcagcctcccaattacttgggaccaccagcatgcttggccgattttttttttttttttttttttgtagaagcaaggtttccctatgttgccaaggctggtcttgaactttagggctcatgtgatactcctgcctcggcctcccaaagtgttaggattacaagcctgagccaccatggccggccaaaatattttcactataacaaatatcatatctgtatatactcagttttaatactaactcaaagtagaaacataaagctgaatgactattttattttcagattctctccattgagtttccttctccgtcttgtgtgatctctgaacttttctccatctttgccacttcttgtctagcattttttttttatcagcagtttcattcagattttttttttagttctttcaacggtggagtggaagtaggcagcaggacagaagaacttgaagcagagcacactggagaggagaaattaacaaagcctttatgaataaaacaaccccccaatatcagtctgtgtgcattatgagcataattgtactttcatctcatctgtaatgttcatgacttttctagaaaattatactttaacatgagaaaagaaaaagaaccagctaattcatagggatggaggacacagcatagtcaaagcaagaatgaaactctctttagtgccacctccagtgcagaataagtaacattcagcagaggcaggtttcatttgataatggattcctataataaactgcgctcagaatttgtgcaggttttaaaatcccgtattccaaacccacttccttagcccccaagttagaaaacagcttcagtaaagaaaattgtacgatgatataactttaccaaaaaataatttctttccatgaagatgatatattattgttgacttctaattcaatcaaatataaacaattgctaaatggcttttcagttgactcctttcttggttaaggagaagataggaaaaaatgaagggatcagaagtcataggatacattaattttttttatctctgaataaacaggttgcctacttaaaaatctatcagtttaaaagtgttggtctcttctctctcttttcagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggtaagtctggtaccacaggaatcagttcacttgctagaatataggatcctttttagtggaatctatatagttattaggggagcatgtgagtcagctcccaggtgggaaagtctgtcctatggtatagtcacaaatataggatcagtcaatcaaatttcacatttactaaggaataagaaagatgtcatctgcctgctctttgccaaacagtgacatttgtaaataatacctcaaagttggaaaagaggtgctgaaagatctccagcatgaaagcatgttgagcttagagtgcttcttttcctagggaagagtggacctaacctgcatggagcactgcaaaaacctgttttatttttgtaaatgtttcatttttagtatataaatttctagtacaataataagtttctagatattttgctatttactctttcagccaatatttgatttatcatgtaatgaaggaaagaatatatacttaaatgaaatttgtaaatgagctaaaaatctcctttaacaaatgctttgtttccttttgtctacctttctctatacacaaatcttttatatttatataactgctaaggacaaataaatactcatgtatttaaaatgtatacattgataatttatttttccaccttttacacatgaactgccagtgtttctccattgacaggaatataggaaagaaacagatgtcacgggggttgtggagaccttaatgcacagaattgatttagcaaatacactacttcgtcaccactgctctcttttcctggacctgggatctgtttctccacacttctttctttaggacccttcatttccactatatattctttcttgttgaacttaagaatgttgttttatccgaaggcaaataccaaaaaacagagggtattcttggattatgcataaactggatggctaatcctgaacagcgtaaagctggttgaaattctaaacagagaatcatagcagttttttgttgttttttttttttaacatgttgtagaaaacacattggtgacagaatacatgactcctgtccagagaaaggagagaaaaagaacagaaaggaaggaaatttgtttattgaacaccttcatattttctcatttaactttgcaggacctctgcaaagtaggtagttatatccctactttacagatgtagtaattaaagctcaagaagctttaataatttgcccaaagtcatgtggtgaacaagtcatggttcaaggaatcagactgtctttcctactttaaaacccagcctcttgctactattttgcactgtaagtgactgatagaaatcctctttctttgtgatttcttaaactactaaaacattttcttggccaatatattagattgagttaagaatagaaatatgaaactagagaattagatctatgtttagtgtttttcactgcgctaattaaaataactctttaggaatatgaagtaaatcattaaagagataaagcccttaaaggcagggagtttagaattattaaattctaataatttagatactgattggagaagagatgtattcataagttattattgttactatttgtctttgtgtaatattgtttgattaaatgatggcaccgacttcattaagtttaaaaactcagtactagttaaatggggcaacttttcataaagctttgctagtccttgagcccttttatttgttaaatggctcaactggaacctaagctgagttgttacaaactattatttgcttcaagttgttttctgttcctggcatggctttttcttttgtgtactgacaaatataaatgttattctgttgagttatggttaactatgaacacagaactgttagggattaattttcatatttcagtttgttgattaattcccaggtatttggcagcatagatattagaaaggaaaatatttaaaagaaagtgtaaaaataacgaagtgtatagagcgaggggtggatagctaattaaaattttgtctggtcctgcctgttcatatgaaaaaaggggttggactttcttctaagggaatatattaaattgctttcatcatattttccttatttctgtctgtcaaggaaaataaattgatacatatatggggagaaaagagatcatttagggaagtggctcatgggactttttgttttgtttgaagtgtattaggaagtcgggtgttttttttctcacttaaattatttaaaacccagaaaagaaatgatatcttctggtttttaaaggagaccatgaagttctgcatagctatcattgatgtgtagttcatactgcatttttagaagtggaaaatagttatttggaggaagataacaaatctggaaccttaggtgcaaggagaaaaagaatagatgaaagggaaagatgtttgtaaattataaaaatttcaattagctattggttttctgcactttatattttaactgcagaatttttcaaaatcagttaatcttggtggaattagcaggatgttaataggagtgactcagaaaaaacattttgtgactgtctaagtttggaaagtattggattaaatacaattgaggtttctttactatggaactcctcagaacttataatatgttgatattctttgattcccagatgaggggatgggtaataggatacatggttttccagacttgtttgaaaatgcaactatttttgggttgcagggaaggatatagtagaactcatgggaactggtgtttcttggaacatgctttggaaatgctgggttatgccctgttaactcttacatcattagtttttagcccaaaaggaaacagcaaataatgttttatatgagccacattttgcgttgattttccttccactctgtaaaattactaaagcagcactctgactttattatgctcaaatcgctcttctccattaatgtgtgtttctccatcttttagggtttttactttataaatacagagattactgtgtaaaattctaaatttgccactgggtcgttatacatttgtaaccttcctcacagtatattttgtgatttggcagagtttaccaatatagatgatactaactgaaattaatcattctgtataattggatagaaaagcatgagtaagaattcaattggtattatatttaattaattgccaagattttcacatttcctgactacaacaataaaatcaaatgaattgatggcttaaaaaaaagaaatctcaaatgtttagtcaatgaagaacatctattgaatgagtgaatgttcattatatatagtgcattttctgagcttttttggagggggaagttgctcccatgctctgagaacttttaaggatcgatacattatttttaacataataatgagaaaacatgagcagagaacccatttctgtcattcccattctctatcctcctgctcccccacctcccaccccagccatcaagctaagtaactattttacacctggacgtagctataggaacaggctactttgaagtctcctagtgacatccttcaagtctgaatgttcaaaggcagtttaacagggaggttgacttaatgagatcatcaaggaaatgtccagtcatcctgaagggtattttggatgggcttccagaatttaaagattaaagtttttttaaggtttttttattttcactgtttatattgccacattaatttccattataaaaccagtaaccatagttttgttttaattagcaatctaattattttcatgtatcctcattatgagaatttatgtccatcactttgcttgatgtgataacagtgacatgctaaatgagaaacaattgttatttagaaaaaaatgcacaaagtgaaagtccttttaatccctaatcataaatacattttattagcttactttaagaagtggcagtcacagctcctgaacattagggagtgtttcttttggtcagcattatttatttagtgcacattgcctttaattttaatttgaaattatagtaaaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccaccaatattgaagattagtattgtgtcacttttgaaagtcagtagaatttatgcaaaaggaacctggaactttaaatcattttgtttttattttctaaagttcatgagactcattcttatggttcatgtttttattttttctctcattctttatcattatgattggaaactcttttaatttaatttctcacacagttattagcataataatctgtttcaggattgtcttggggatcatcacaaagaagaacatattagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccattctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttatgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctc

SEQ ID NO: 14451 - DNA, 5743 bp, Human; identical to SEQ ID NO: 12687

SEQ ID NO: 14452 - DNA, 11032 bp, Human
gcgctttcccagaactggcccagaggagccagttcagagtgtgaggtcgggtctgcattgaacgtacacaccgaggtctatcagactcccccgattttagcgaagggtgctgactgctgtgctgctagaggctagcaagctccctgtgcgcagctgatgagtttcagcaactcgccacctgggcgcttttctttaaattttgggagtaaactgggaaaataaaaaaatctccacgtccactggctctctccccttctccaacttcctctttcgactcgtttgtgggagttttctcctctttgctgggactataatgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatggcccccttcgtcttccaggtaaaatgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagtcgggctgcaggcgcacgggcaaagaacttagcatctcatccaagtacttcgccttccttggccgtctccgggaggttatgcttaaaaacataaaaataaaaataaaaataaaaataaagggaggcggacaaagtttcggtgggtgaactgaagctgggtccatgtgaccctgaagccggagaaataaacttaacatgaatcttgctttcctggcgggcgttgggaccccgccgtttttcatgccaaccgttggaagcttcgtactcaacggccacaggtgcctaggagcgcagagaggcctcgggttcaaatcaccggcgcgcagggactggactcgcgggtagcgacccccccaacccccccccccccgccctacacacacaccctcgcgccggctgaaagcatggaggattcagggcatttgaaaaaagaggggctgggcgcggtggctcacgcctgtaatcccagcggtttgggaggtccagaagggcggatcacttgaggtcaggagttcgagaccagcctggccaacaccagcctggccaacatggtgagaccccgtgtctactaaaaatacaaaaattagccaggcgtggtgcctgtaatatcagctacttgggaggctgaggcacgagaatcgcttgaacctgggaggcggaggttgcagtgagcccagatcgcgccaccgccctcctgctctgggtgatagagcaaggcactgtctcaaaacaaaacaaaacaaaacgaaagattcggtcaggaaagaatctgcaggcattcgaggcgctcgcactttgcaaagtaaatgcaatctctttattaagccgaagtccctcatatctatccttttagaggaaggtggtccaactcagaaatctctcccaagaggactttccaccgaagactaccgcgaagtgccaggaactcgccccagtcccgacaggtgcaggacctttcgtgccgccacaccttgggactctacctccctaaataggccacttaaaagccagtagtgcaaccgggatcccgcggcgataaagaatcactgtgcagaaccctggagctgggagtcggcccgcccccctcccaaagaaaccgggatcccgcgtcctccccgccgctagcgcagcgcgccagcggcgcccaatcagtgagctttccgggtctgtgacggccttcggctccgccccctcgacggccataaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggtgagcagcagcgcagcacccctgcccggcgagcttaacttgcccagcccggcccctgccggagtggcaccggcacctctccaagacgccctcttccctgcaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaaggtatgatgtgtgactcccaggggaagtgggctccgcggagatgccccctcccatccctgaccttttctcttccccgcgagtagggatctaattcctggacacctcccctaccacttccataccatcctttttctttttccttttttttttttttttttttttttttttgaaacggagtctcgctctgttgctcaggctggagtgcagtggcgcgatctccactcactgcaaactccgcctccaaagttcacgccattctcctgcctcagcctcctgagtagctgggactacaggcacccgccaccacgcccggctaatttatttttgtatttttagtagagatggggtttcaccgtattagcaaggatggtcccgatctcctgacctcgtgatcctcccgcctcagcatcccaaagtgctgggattacaggcgtgagccaccgtgcccggccttccataacattcttaaagttctagattaagtaaggaaagttctggtgttcctaaggtaggctaagtaaataagcaaatggcaacgtgccttgcaggatatctcgaaatgcttagagaaaggatgtggcaatgcaggaccgcttccagagattccagagctgcccagtattgctgcagaagtcatcaggtgtccacccacagtgtagttcaaacgacaaagggcaagtgactgggggtgggggatacaaggaatcagtcaccgctgcttgcaactttaaccaagaatttcacttgaaaggaagaggtccagagtttatatttaatccataacactataaacaaagtgtgtgcctttaaaataaggaaccatgcagttttctccctttgaaagctgcatagagggatttttcattgcttgctataagctatcaaaattcccagtaagagggcccccctggtagttcccttattctttgtgttggtgcttcagagttgtattttccatggtattctgaattctttctgggttggctttgatcctcatctagacttcattgttaagcatcctttacccattagccctgaaggtagattacattgtttatgggttccccagagatcaatacaattagttttcaagaagagatgttaaacattggaaggtaatttttatgagtattttgaaaaaatactcatgattattaaattagccacaaatccaaagggaaaaatggatttttatttccttttaaaacctcttaacttttaaaaatagttaagattttaagcctgaaacttcacttacaattggaaactttctcagccttcattgcacttgttaaagaagtcattgttaatgttcagtctttataatggaaacctgggcaataacatatgagctttagtgttactcttcatgtttagatatttttgggaccagaaaaagctaagtcagtttttttcatgtaaccagtttttaattgctccacatcttggttaatttttttgacccatttgggaacatctttctctatcctctgtgggagagcatggaagtattttgcttttatagatcggtgtatgaaactccttatagattttatagagccacaaaagactcaatctaggaattcttttccaagtaaaataaaaatacagttagagcactgtgcagcgattcaagaatcacagctctagtccaggcctgtttagaaatgaactccaccacatttacaaacacgggctcccaaagtgtacaaaaggaaacatgtcagatttacttaggaaccaagcaaatcatttctctaaggaaaaacagtatttctatcaggtaattaggagttaccctttcatggaacacatatagcgctgcattatatatttctacagaaaaacagtaactagtgcttttgtaaggtagtaaaatatttaatctgcataaataactagttggagtagtttttcatctttggaaactttgttagggtctacagaagtagagaagtgttttaattgctgttgctgcatagcacctcttgtgaaactgagttttgtcttcactttgaatggtctaacaaacaatttggccacagagtagatttcccgggggaaaaaaaaaagttttcatcccaaatttcctaattctacaaactgtttttgaacatgcactgagagaagtaggtcattaatactgaaggaaggactggtttctactttttagaaacataagaaattatttgattctgggtctgattgctgagttctccatatatgcaactaatattaacatgagagttacaaagttgcctcttacttaaatttgagttaataaaaactctcaagaacacactacccctaaggaaaacactgcaattagtttgcaaatgaatgaactggaaaagaacatttactcctttgtggtaacactctattttacaagtttagaagtcataaaataatgggatttttataatactgttgacaatcagtattttgtaaactaaaaattcctttggttaataactattactattccttatgctttttctactatgatttttttttactttgttaatactgctctttcattgccaaaaatgattgcaaatgccccttttaatttgtgtggattgagtgctcacaagagtgttcctacagacttattgaccccttctagaaatttcctactgttgagcaccactaaagatgcctgctggtctgctgaccaagtgaacaggaacagggtattagacatgagttgctttttgagaaaaatctgcttttgtgggaaatacagtcgaaaatgattctgattgacttaattataaattaccaaggaaaaaaataaggataactgtatttacaacttagtcatttacaaaaatatgtcttccatcaacctccttttctccttgtcctgaaaacttcaatttgatctttaccatcttaaaatagtatacttctcaatgccttgctagtttattaaaaaaggacaaatagtatgtctgatagaaaaataggccaacatctagataagtttcacacttgtttaggtaattgtgtaaaagtatggatagagataaccatactgtcaaagtggtgtattaaaacatattgaacttgttcattctatcacttaataatttggaaacctagctgcccagtaccatgtaagccactgtagaaaaccctaaaagaacataaaatgccatgtctagaaacagagcttaaaattagtatgaatagcaaaacccatatagaaatgactgacaatcactgcattctggcatcaacggcaatatggtagagataactgtcaacaaatagagtactaataataatcactgtaataccttatgtttatacagcacgtagaagaatacagaggacttgtgcatcaaacatctcagttaatcctcagaacaatttgagtgttcccatttgactacttgaggtgacatagccaataagagctggagccaggactcagacataggccatcatttctaagtaaaattatttttctaaggaaaacattacacatattagaaggatgcattcctcaggggtaaggacaatatttgtctttttttccagcagccagttatgtgtcacataattgatcctgaatttagcatatttagtcaggaaatgggatttgacaataaaattagactttctatgcctgtagattttgagacttataaaaaagttatcattggtatcattagattttagaatggcagattggaggaattgaatctacttttaattggccaaattctattatttttactcaagattagagacacctctttgctcatctaattttaaaatatgctattgttattgataagcagtttgatgttttaaacctttagtcctgaataactatgtggttatactttctatagttttctataaatgctgtatttacataggcaactgccattattagttgcctaagggatcatttctgctactatacggtatagaatcagaactggactcttaacattgtaaatttttttgtaagtcataagaaaaagtctagttcttctggtagacagaaaatagctgggaaaactgatttactgtttgatatatgtgattcttcttgggtttagccacctttcctaattttccaatattttattttccagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaagaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagtttta

SEQ ID NO: 14453 - DNA, 11585 bp, Human
atacacattagctattactctattaggattggcttcatgtaggaagcagaatttgaggcaaggtaggattgccagataaagtacaggatgtccagtaaagtttgaatttcagatgaacaacaaaaaaattttaagtgtgtctcaaatatcacatgagacatacttatactcaaatagatttgttgtttatctgaaattcaaatttaactgggacactcttatttttatttgctatttccgccaacctaatacatctggtaaatgtaagctgaagatgttttttacctttattgaagtataattgacaaataaaaattgcataatttaggttgtacagctggatgtttgtttttttattttcctttaaaggggaacttctctctgattggtgttttgatacacataaacattgtgaaatgattaccactattaatctaattagcacttaaaacacctcatatagttatctttttgtgtggtgagaagacttaagatctacctttttagcaaatttcaaatatacagcataatattatcaactatagtcaccatgctgcacattggactccagaacttatttatattgcataactcaaactttgtgccctctaaccaacatctcccccatttctcctatgcctcaggccctggccaccaccattctacacttttcttccgtgagtttgactattttagatttcacatgtaagaaagatcatacagtatttgtctttcttttccgtttttttttttttttttgagaaggagtctcactctgtggcccaggctggagtgcaatgatgcaatctcggctcactgcaacctcctccacctcccgcgttcaagtgattctccctgcctcagcctcctgagtagctgggattacaggtgcctgtcaccacgaccagctaagcagtatttgtctgtctatatctgctcatttcacttaggataatgccctctaggttcatcaatgttactgcaaatgacagaatttccttctttttcaaggctgagtaatactccattgtgtatatatatatatatacacattttctttatctactcatccatcagtggaaacaggttgttttcatatctcggctattgtcaatatagctacaatgaacatgggaatgcaggtgtctcttcaagatcctgatttcatttcctttggaaatacactcagaaatgagattgctagcacagaaacaggaaataaatggtatttttcatggcactttatgatctcccataattcactgagtatttcctatgtgacagtcactgttctgagagatttacaagaattaactcatttattcttcataaaagcatggggtagcttatcagcatccttattttataaatgaggaaactgaagtataaagaggtaaagtaacttgtccaagaacatagagcagggaagtggtgcagcttggattatgaacccaagatgttttgttcctggggctgctgtcatcttaatattttaaatagagaaaagtaatatgttctaaataaacttatagaaagccttcagggccagcttatccccaaagttattttttttataagccagatcacccaaccctaatttctgcataaagtgaaatattgtttgctaaatcactactactgggggctacagctagcttacctaagcaccttctatattctttcacgtttagaaatatggatataccctcctatgctcctcttttcattctcaaagccaccctgttcctggaatgtgagatctcctaattgttgactggagaatcaaatgctacctttgcaacagcttatcggaagcaaacaagctgaggggaattgagcaagaatttctgggataccaacagcataggaggaacaaaggacgtagagggagggttgactgtctacacaggacaaagccaatgattaaccaaacctcttgcagatttaaataggatgggaactaggagtggcagcaatcctttctttcagctggagtgctcctcaggagccagccccacccttagaaaagatgttttccatgaggatcgtctgcctggtcctaagtgtggtgggcacagcatgggtatggcccttttcattttttcttcttgctttctctctggtgtttattccacaaagagcctggaggtcagagtctacctgctctatgtcctgacacactcttagctttatgaccccaggcctgggaggaaatttcctgggtgggcttgacacctcaagaatacagggtaatatgacaccaagaggaagatcttagatggatgagagtgtacaaactcacaagggaaactttagcatctgtcattcagtcttaccacattttgttttgttttgttttaaaaagggcaagaattatttgccatccttgtacctataaagccttggtgcattataatgctagttaatggaataaaacattttatggtaagatttgttttctttagttattaatttcttgctacttgtccataataagcagaacttttagtgttagtacagttttgctgaaaggttattgttgtgtttgtcaagacagaagaaaaagcaaacgaattatctttggaaatatctttgcagtatcagaagagattagttagtaaggcaatacgcttttccgcagtaatggtattcttttaaattatgaatccatctctaaaggttacatagaaacttgaaggagagaggaacattcagttaagatagtctaggtttttctactgaagcagcaattacaggagaaagagctctacagtagttttcaactttctgtctgcagtcattagtaaaaatgaaaaggtaaaatttaactgattttatagattcaaataattttccttttaggatggattctttaaaactcctaatatttatcaaatgcttatttaagtgtcacacacagttaagaaatttgtacaccttgtctcctttaattctcataacaactccataaaatgggtcctaggatttccatttgaagataagaaacctgaagcttgccgaagccctgtgtctgctctccttaatctctgtgagagtgccatctcttcctggggacttgtaggcatgccactgtctcctcttctggctaacattgctgttgctctcttttgtgtatgtgaatgaatctttaaagactgcagatagtggtgaaggtgactttctagctgaaggaggaggcgtgcgtggcccaagggttgtggaaagacatcaatctgcctgcaaagattcagactggcccttctgctctgatgaagactgggtaagcagtcagcgggggaagcaggagattccttccctctgatgctagaggggctcacaggctgacctgattggtcccagaaacttttttaaatagaaaataattgaatagttacctacatagcaaataaagaaaaggaacctactcccaagagcactgtttatttacctccccaactctggatcattagtgggtgaacagacaggatttcagttgcatgctcaggcaaaaccaggctcctgagtattgtggcctcaatttcctggcacctaatttatggctaagtggaccctcattccagagtttctctgcgacctctaactagtcctcttacctacttttaagccaacttatctggaagagaaagggtaggaagaaatgggggctgcatggaaacatgcaaaattattctgaatctgagagatagatccttactgtaattttctcccttcactttcagaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaatagtaagtattacatatttactgctttgactttataacagaaacaacaaaaatcctaaataaatatgatatccgcttatatctatgacaatttcatcccaaagtacttagtgtagaaacacataccttcataatatccctgaaaattttaagagggagcttttgttttcgttattttttcaaagtaaaagatgttaactgagattgtttaaggtcacaaaataagtcagaattttggattaaaaacaagaatttaaatgtgttcttttcaacagtatatactgaaagtaggatgggtcagactctttgagttgatatttttgtttctgctttgtaaaggtgaaaactgagaggtcaaggaacttgttcaaagacacagagctgggaattcaactcccagactccactgagctgattaggtagatttttaaatttaaaatatagggtcaagctacgtcattctcacagtctactcattagggttaggaaacattgcattcactctgggcatggacagcgagtctagggagtcctcagtttctcaagttttgctttgcctttttacaccttcacaaacacttgacatttaaaatcagtgatgcaacactagctggcaagtgagtgatcctgttgacccaaaacagcttaggaaccatttcaaatctatagattaaaaagaaaagctcatcagtaagaaaatccaatatgttcaagtcccttgattaaggatgttataaaataattgaaatgcaatcaaaccaactattttaactccaaattacacctttaaaattccaaagaaagttcttcttctatatttctttgggattactaattgctattaggacatcttaactggcattcatggaaggctgcagggcataacattatccaaaagtcaaatgccccataggttttgaactcacagattaaactgtaaccaaaataaaattaggcatatttacaagctagtttctttctttcttttttctctttctttctttctttctttctttctttctttctttctttctttctttctttctccttccttcctttcttcctttcttttttgctggcaattacagacaaatcactcagcagctacttcaataaccatattttcgatttcagaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtaagtatgtggctgtggtcccagatgtccttgtttttgagtagagggaaaaggaaggcgatagttatgcactgagtgtctactatatgcagagaaaagtgttatatccatcatctacctaaaagtaggtattattttcctcactccacagttgaagaaaaaaaattcagagatattaagtaaattttccaacggtacatagatagtaaatttcaaaagcaaatgttcagtccctgtctaattccaaagcccattacatcaccacacctctgagccctcagcctgagtttcaccaaggatcatttaattagcgtttcctttgagagggaatagcaccttactcttgatccattctgaggctaagatgaattaaacagcatccattgcttatcctggctagccctgcaatacccaacatctcttccactgagggtgctcgataggcagaaaacagagaatattaagtggtaggtctccgagtcaaaaaaaatgaaaccagtttccagaaggaaaattaactaccaggaactcaatagacgtagtttatgtatttgtatctacattttctctttatttttctcccctctctctaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaatccagtataccaccctttcttacatagcttctattctgatataactgcattatccctcaaagaaggaaggagagagggagggaaggagaggagaagagagggaggaggaaaaagaggctacagctaggggccagagcctggggatcaaaggggaaataaccttgcaaatgcatcacagatgaaccccagagttcttgcatttctttatggggaattgtaaatctctgatacaaactaaacgctataccttcaaatggttggatacttggacaagaacttcttcagaatcaaatgaagcttcacttctttcagacatcagaacttcatgctatctctatccccactctacttacactcacacgtattgccttgacagaatttgagttgagactagaaaatattttgttttccagaatagcatactatgtaggaatataaatggttcctggaatgaaagtgattatgaacgggaagggccattcatttctagttattcagaagattttgagtttatcaaaggattagataaacctcttttaatttaataaatggtagccaatattagcaggatcatgagaattggagatacaatttggttgtcagaaaagacatgaaacatctattttccatttcaccttatctttaggtgaaattttttctgaaattatttcattttttctgaaattaaatattaatttagctccctgactcttattcactcagaagcccatttcaacttggttttcatgcaattaccacactcttgaaattgatctcaaatcaacacaactttgcaattgtaaattaaatgtgctgcattcaagcctctttctacttctctcttttaaacatctgctacttattttgcccttatcctgcctcttgggcctgtccttttgtcttggtttctataccatttcttcccgtcttactcttttcagtgtttttaactggtaatttcttctctgaccacttcttaaatgtaggggtttctcattgcatttacattggtactcatctttatcatttgggattaggtttggtacatctgacttcaacaaggcaaaaattcatttcctgctcacaaaaaagcctatgtaggagtatgtccacatagtcttcagaaagccgtcattttaataaaagacttctatcccttggttcaacttgtaatccaaatatcatgtcctctggcaatctggaagaaggagaaaagaaagaagggcaaaggagtaccttctccttttaaggaactttcttgagtgttctaaacagcacttctgcttatattagccacaacttagtcacatagataagctcagttgcaggagaagctgagtcaagttgactattagcttgggtacaagactatcctaactaaaatcaggattctgctaataaggaaaagagggagaatagataaggaagtctgcaattaccagtcttggccaaacattttctcgctcttctctttctccttgattgatctgacaatcaccatagcttcaactacaatcagtggccttaagcaggaggcagacattaagattaagttaaaacttcttagcttggaatataaactctttcaaaaattggtccattttcaacctctgcaatcattcattctacacattagttacactgaatttctcactggcactgaaataccaggtcctttaatgatttggggccttttcacaaactacctagaagacacccattcactcctttaaaaacagctcaatgctgcttctgtgaacccttccccagtgcccatcatagaatgaattgaattgtcctctaggtcctcactgtttttgttcttatctcaaaaatagcatattctatccctacctctaacatatttatattatttgtggcactaggttatgaactcctttgggacagagctcatttatatggtgcatcctgtcctacacaaaatgtttccccattctaagattatacagtatttcaaatacttccttaaatttttaa

SEQ ID NO: 14454 - DNA, 12069 bp, Human
cacttaccatgaattgggtaatgtgctcaacacattatcccactaaatcttagtaatagccctattaagtaaataccatatcataagtattatctctcttttactgacatggataatggaactcaaggagattgagtaacttgtactgaatcacacagccagtaaattgtaaagatgggactcaaacctagggagatggactccagagccttaacaactatttatttatacattctccaattgagctacacacttcttgaaggcaaaggcaatgcctgagtcacctttcatgttcaaatcatattaaaaagttagcaagatgtaattatcagtgtactatgtaaatctttgtgaatgatcaataattacatattttcattatatatattttagtagataatatttatatacattcaacattctaaatatagaaagtttacagagaaaaataaagcctttttttccaatcctgtcctccacctctgcatcccattcttcttcacagaggcaactgattcaagtcattacatagttattgagtgttaactacaactatgttaagtacagctatatatgttagatgccgtagccacagaaatcagtttacaatctaatgcagtggttacagcatgtatacatataatataaggttgctacaaatgctatctgaggtagagctgtttgaaagaatactaatacttaaatgtttaattcaactgacttgattgacaactgattagctgagtggaaaagatggatgagaaagattgtgagacttaattggctggtggtatggtgatatgattgacaataactgctaagtcagagagggatatattaaggaggagaagaaaagcaacaaatctggttttgatgtgttcactttgttataattattgattatttactgaatatgaatatttatctttgtttttgagtcaataaatatacctttgtaaagacagaattaaagtattagtatttctttcaaactggaggcatttctcccactaacatatttcatcaaaacttataataagcttggttccagaggaagaaatgagggataaccaaaaatagagacattaataatagtgtaacgcccagtgataaatctcaataggcagtgatgacagacatgttttcccaaacacaaggatgctgtaagggccaaacagaaatgatggcccctccccagcacctcattttgccccttccttcagctatgcctctactctccttagatacaagggaggtggatttttctcttctctgagatagcttgatggaaccacaggaacaatgaagtgggctcctggctcttttctctgtggcagatggggtgccatgcccaccttcagacaaagggaagattgagctcaaaagctccctgagaagtgagagcctatgaacatggttgacacagagggacaggaatgtatttccagggtcattcattcctgggaatagtgaactgggacatgggggaagtcagtctcctcctgccacagccacagattaaaaataataatgttaactgatccctaggctaaaataatagtgttaactgatccctaagctaagaaagttcttttggtaattcaggtgatggcagcaggacccatcttaaggatagactaggtttgcttagttcgaggtcatatctgtttgctctcagccatgtactggaagaagttgcatcacacagcctccaggactgccctcctcctcacagcaatggataatgcttcactagcctttgcagataattttggatcagagaaaaaaccttgagctgggccaaaaaggaggagcttcaacctgtgtgcaaaatctgggaacctgacagtataggttgggggccaggatgaggaaaaaggaacgggaaagacctgcccacccttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcagtaagtgtgctcttcacaaaacgttgtttaaaatggaaagctggaaaataaaacagataataaactagtgaaatttctgtattttttctcttttagtatgttgctaccagagacaactgctgcatcttagatgaaagattcgtaagtagtttttatgtttctccctttgtgtgtgaactggagaggggcagaggaatagaaataattccctcataaatatcatctggcacttgtaactttttaaaaacatagtctaggttttacctatttttcttaatagattttaagagtagcatctgtctacatttttaatcactgttatattttcagggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaagtgagaaaataaagactactgaccaaaaaataataataataatctgtgaagttcttttgctgttgttttagttgttctatttgcttaaggatttttatgtctctgatcctatattacagatatgatagacgctgctactttgaagtccaggaaaatgttagaagaaattatgaaatatgaagcatcgattttaacacatgactcaagtattcggtaaggatttttgttttaatttgctctgcaagactgatttagtttttatttaatattctatacttgagtgaaagtaatttttaatgtgttttccccatttataatatcccagtgacattatgcctgattatgttgagcatagtagagatagaagtttttagtgcaatataaattatactgggttataattgcttattaataatcacattgaagaaagatgttctagatgtcttcaaatgctagtttgaccatatttatcaaaaattttttccccatcccccatttatcttacaacataaaatcaatctcataggaatttgggtgttgaaaataaaatcctctttataaaaatgctgacaaattggtggttaaaaaaattagcaagcagaggcatagtaaggattttggctcctaaagtaaattatattgaatgtggagcaggaagaaacatgtcttgagagactaagtgtggcaaatattgcaaagctcatattgatcattgcagaatgaacctgcatagtctcttcccttcatttggaagtgaatgtctctgttaaagcttctcagggactcataaactttctgaacataaggtctcagatacagttttaatatttttccccaatttttttttctgaatttttctcaaagcagcttgagaaattgagataaatagtagctagggagaagtggcccaggaaagatttctcctctttttgctatcagagggcccttgttattattgttattattattacttgcattattattgtccatcattgaagttgaaggaggttattgtacagaaattgcctaagacaaggtagagggaaaacgtggacaaatagtttgtctacccttttttacttcaaagaaagaacggtttatgcattgtagacagttttctatcatttttggatatttgcaagccaccctgtaagtaactacaaaaggagggtttttacttcccccagtccattcccaaagctatgtaaccagaagcattaaagaagaaaggggaagtatctgttgttttattttacatacaataacgttccagatcatgtccctgtgtaagttatattttagattgaagcttatatgtatagcctcagtagatccacaagtgaaaggtatactccttcagcacatgtgaattactgaactgagcttttcctgcttctaaagcatcagggggtgttcctattaaccagtctcgccactcttgcaggttgctatctgctgtcccttatgcataaagtaaaaagcaaaatgtcaatgacatttgcttattgacaaggactttgttatttgtgttgggagttgagacaatatgccccattctaagtaaaaagattcaggtccacattgtattcctgttttaattgattttttgatttgtttttctttttcaaaaagtttataattttaattcatgttaatttagtaatataattttacattttcctcaagaatggaataatttatcagaaagcacttcttaagaaaatacttagcagtttccaaagaaaatataaaattactcttctgaaaggaatacttatttttgtcttcttatttttgttatcttatgtttctgtttgtagatatttgcaggaaatatataattcaaataatcaaaagattgttaacctgaaagagaaggtagcccagcttgaagcacagtgccaggaaccttgcaaagacacggtgcaaatccatgatatcactgggaaaggtaactgatgaaggttatattgggattaggttcatcaaagtaagtaatgtaaaggagaaagtatgtactggaaagtataggaatagtttagaaagtggctacccattaagtctaagaatttcagttgtctagacctttcttgaatagctaaaaaaaacagtttaaaaggaatgctgatgtgaaaagtaagaaaattattcttggaaaatgaatagtttactacatgttaaaagctatttttcaaggctggcacagtcttacctgcatttcaaaccacagtaaaagtcgattctccttctctagattgtcaagacattgccaataagggagctaaacagagcgggctttactttattaaacctctgaaagctaaccagcaattcttagtctactgtgaaatcgatgggtctggaaatggatggactgtgtttcagaaggtaattttttccccaccatgtgtatttaataaattcctacattgtttctgccatatggcagatacttttctaagcaccttgtgaaccgtagctcatttaatccttgcaatagccctaagaggaaggtacttctgttactcctatttacagaaaaggaaactgaggcacacaaggttaaataacttgcccaagaccacataactaataagcaacagagtcagcatttgaacctaggcagtatagtttcagagtttgtgacttgactctatattgtactggcactgactttgtagattcatggtggcacataatcatagtaccacagtgacaaataaaaagaaggaaactcttttgtcaggtaggtcaagacctgaggtttcccatcacaagatgaggaagcccaacaccaccccccaccaccccaccaccatcaccaccctttcacacaccagaggatacacttgggctgctccaagacaaggaacctgtgttgcatctgccacttgctgatacccactaggaatcttggctcctttactttctgtttacctcccaccactgttataactgtttctacagggggcgctcagagggaatgaatggtggaagcattagttgccagacaccgattgagcaatgggttccatcataagtgtaagaatcagtaatatccagctagagttctgaagtcgtctaggtgtctttttaatattaccactcatttagaatttatgatgtgccagaaaccctcttaagtatttctcttatattctctctcatgatccttgcagcaaccctaagaagtaaccatcatttttcctatttgatacatgaggaaactgaggtagcttggccaagatcacttagttgggagttgatagaaccagtgctctgtatttttgacaaaatgttgacagcattctctttacatgcattgatagtctattttctccttttgctcttgcaaatgtgtaattagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccaggtactgttttgaaatgacttccaactttttattgtaaagattgcctggaatgtgcactttccaactatcaatagacaatggcaaatgcagcctgacaaatgcaaacagcacatccagccaccattttctccaggagtctgtttggttcttgggcaatccaaaaaggtaaattctattcaggatgaatctaagtgtattggtacaatctaattaccctggaaccattcagagtaatagctaattactgaacttttaatcagtcccaggaattgagcataaaattataattttatctagtctaaattactatttcatgaagcaggtattattattaatcccattttatagattaacttgctcaaagtcacattgctgataagtggtagaggtagaattcagactcaagtagtttaactttagagcctgtcctcttaacaactatcctggttgaaaagcaaatacagcctcttcagacttctcagtgccttgatggccatttattctgtcaaatcatgagctaccctaaaagtaaaccagctagctcttttgatgatctagaggcttctttttgcttgagatatttgaaggttttaagcattgttacctaattaaaatgcagaaaaatatccaaccctcttgttatgtttaaggaatagtgaaatatattgtcttcaaacacatggacttttttttattgcttggttggtttttaatccagaaagtgctatagtcagtagaccttcttctaggaaaggaccttccatttcccagccactggagattagaaaataagctaaatattttctggaaatttctgttcattcattaaggcccatcctttcccccactctatagaagtgttgtccacttgcacaattttttccaggaaagaatctctctaactccttcagctcacatgctttggaccacacagggaagactttgattgtgtaatgccctcagaagctctccttcttgccactaccacactgatttgaggaagaaaatccctttagcacctaacccttcaggtgctatgagtggctaatggaactgtacctccttcaagttttgtgcaataattaagggtcactcactgtcagatactttctgtgatctatgataatgtgtgtgcaacacataacatttcaataaaagtagaaaatatgaaattagagtcatctacacatctggatttgatcttagaatgaaacaagcaaaaaagcatccaagtgagtgcaattattagttttcagagatgcttcaaaggcttctaggcccatcccgggaagtgttaatgagctgtggactggttcacatatctattgcctcttgccagatttgcaaaaaacttcactcaatgagcaaatttcagccttaagaaacaaagtcaaaaattccaaggaagcatcctacgaaagagggaacttctgagatccctgaggagggtcagcatgtgatggttgtatttccttcttctcagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtatgttttcctttcttagattccaagttaatgtatagtgtatactattttcataaaaaataataaatagatatgaagaaatgaagaataatttataaagatagtagggattttatcatgttctttatttcaactaagttctttgaaactggaagtggataataccaagttcatgcctaaaattagcccttctaaagaaatccacctgctgcaaaatatccagtagtttggcattatatgtgaaactatcaccatcatagctggcactgtgggttgtgggatctcctttagacatacaacataaatgatctggatggattaacattactacatggatgcttgttgacacattaacctggcttcccatgagctttgtgtcagatacacgcagtgaacaggtgtttggaggaacagaataaaaagaaggcaagcactggtaagggcaggggtttgtgaaagcttgagagaagagaccagtctgaggacagtagacacttattttaggatgggggttggatgaggaggctatagtttgctataagcttggaatggtttggaacactggtttcactcacctacccagcagttatgtgtggggaagccttaccgatgctaaaggatccatgttacaataatggcattatttggaaatcccagtggtattccatgaataaaaccactatgaagataatcccactcaacagactctccgttggagaaggacagcaacaccaccctgggaaagccaaacagtcagaccagacctgtttagcatcagtaggacttccctaccatatctgctgggtagatgagtgaaaccagtgttccaaaccactccgggcttgtagcaaaccatagtctcctcatctaccaagatgagcaaccttacctcctgatgtcctagccaatcaccaactaggaaactttgcacagtttatttaaagtaacagtttgattttcacaatatttttaaattggagaaacataacttatctttgcactcacaaaccacataatgagaagaaactctaagggaaaatgcttgatctgtgtgacccggggcgccatgccagagctgtagttcatgccagtgttgtgctctgacaagccttttacagaattacatgagatctgcttccctaggacaaggagaaggcaaatcaacagaggctgcactttaaaatggagacataaaataacatgccagaaccatttcctaaagctcctcaatcaaccaacaaaattgtgctttcaaataacctgagttgacctcatcaggaattttgtggctccttctcttctaacctgcctgaagaaagatggtccacagcagctgagtccgggatggataagcttagggacagaggccaattagggaactttgggtttctagccctactagtagtgaataaatttaaagtgtggatgtgactatgagtcacagcacagatgttgtttaataatatgtttattttataaattgatattttaggaatctttggagatattttcagttagcagataatactataaattttatgtaactggcaatgcacttcgtaatagacagctcttcatagacttgcagaggtaaaaagattccagaataatgatatgtacatctacgacttgttttaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcatttttatgaccacttgtcatttattttgtcttcgtaaattattttcattatatcaaatattttagtatgtacttaataaaataggagaacattttagagtttcaaattcccaggtattttccttgtttattacccctaaatcattcctatttaattcttctttttaaatggagaaaattatgtctttttaatatggtttttgttttgttatatattcacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactagatacatggtacctttattgaccattaaaaaccaccactttttgccaatttaccaattacaattgggcaaccatcagtagtaattgagtcctcattttatgctaaatgttatgcctaactctttgggagttacaaaggaaatagcaattatggcttttgccctctaggagatacaggacaaatacaggaaaatacagcaacccaaactgacaatactctatacaagaacataatcactaagcaggagtcacagccacacaaccaagatgcatagtatccaaagtgcagctggagacaggaaagctgcttggggagtctcccagcagaaccttttagctccaaacacctgtggtgggacctggtcactctgaaaggactgcaactcagagcagagagctttagggagctatttgccctatctctcactagtcatgaggtgagctgaatggaaccatctcttccttctgattcagggatattgactttttagcagcctgagttcaggttcattcgccaactttctaaggaatagctaaatctacataacttagcaaaaggctgactgtgggaagtaattggctaattttatgaggtgggtctggttgttccgaagtcctgagctttggctttgcactctctttcttttcacacttctttctttcttcttgcctttcctttttttttttggatatagggtctcactctgtcacccagtctgtaatgcagtggcacaacagtagctcactgcagccagccttgaactcctgggctcaagtgatcctccttcctcagcctcccgagtagctgtgactacaggagtgcaccatcacacctgcctaatttttctttaatttttatttttgtagagaaagagtctcactgtgttgcccaggctggtctcaaatgcctggcctcaagggatcctcctgcctcggcctccaaaagtgctgggattacaggcatgagctaccatgccaggcccacaatttccttcttaatcttttcactttcttgttatcaggagtgctgaatttaagatatcctattgaagagataaaaacagtaagtcagcttctagatatacaaccgaagacgtgggaggctttggaaaatagaaacattgattcattgtttgcagccttcatatatacatgtatgcatgaagcacttattcaattaacatttattgaatgccttccttgtggtagccattgtgttggatttggggatatagtacatggtatgcttagtgttctccactctcccaaacctgttctactccatccagtcctcaaatgcaaaaaaaacagtgactcatcctccaatcttcctccccatatccaatttctacctccctatatccaattactcatcaagcctgctgaattcacctcctatatatttatcatattcacttttttcctgtataccgattgtcacctttgtagttgagatacatctcttgccaggataagggcaatcacccacttcctgttccctttcttacatccagcctctcctgctaccatctcatcctcctccaaaccacttct

SEQ ID NO: 14455 - DNA, 12069 bp, Human; identical to SEQ ID NO: 14454

SEQ ID NO: 14456 - DNA, 13031 bp, Human
actctccagatgataaagctgaataaaaagtgctacactaaccagtggtcagtccaggctctgctgcaacattgcactaaccagaactgcagacctgggacctcaagaattgcatttgatgccgaacccagctctaatttcagagtcaaggtctctgcgagtatttaaggaacggatgtaaacctgggggattcgttttgtttccttcaattttccaatgaaatcagagatcctgttcttgggtgtcaacgcagatactagaaggaggtgatacaagagaaaggaaacagcaagcgacgattatggcacggtttcctgtaaacaaggttgagtgtagccacagcctgagcactgtgggagaagagctcataagaaaatgacggtgctgggccttcgtcaccccggggccctccattgttcttgtctttggtctctttttatttgtagaggtccaattatttatttatttagtacaagagggaacgaaattgatctttccattctaaaaggagagtatatatgtataaaaggaagctgtatagatatgggggaagaggtggacagggggaaaaggggagaggacgagagagagaaagggagggagagggacaaggagagacactgggcgagagatcgattaggagagacagaaatgatgaatgaagattaacttcacccaaggcttcgtgctggaggggaatggaggagctcctgatttgctattactactccaaactgcaaagggctccttcaagtcacctatccacctcctaaggcaagcgtccaatttcaacagcgttcaggaaagtctcctcccgcggaggtctcaccgcttcccactccacccccacaaactctttggaaaagtgccttgaaaaatttaatcctcaatccaatcctggaccaccagcgtcctctgttggtcaccgaagggagggggtgcgcagacaaaactgaagaaactcgagtgccagagaaggccgacaggagttacagcgacctcagcgcgcaattgcgcccccgaactttactgaaaagtgtttagattgcagagataagctagaatcccaacgcatcgagaatacagtaatacgaagtcgccttcaaaaaatgacaatgaaaattgcctattaaaggactatttggttaattacgtttcagcagtgcccagtttattgtctttattattcttttgtcatgggtgtaaactccatttgaaaacataatcagggagaatacccaagacaagaagaacagttgtcatttaaaatatttgaaaagccctgccttaaggacgcattcgcttgccggtccactcttaattggggacttgcggtgtagcaacacgtgagagtcttcttgcgttgagaagtaagcctggaaaggggcgaaggccccgggcgcatcttcagatgcgtatttgtgggcccctggggatataaacagcccagcgggtgtaaattaaaccccgcagtgccttggctccctgagacccaaatgtaagtcagaaatgtcccaagacttcgcctgccaacggaattaaattttagaaagctccacgaggtacacacgaatgcggagcgctgtatgccagtttccccgacaccggctcgccgcagggagacctcaccccgagagcggaaggggtaagggcggcggggtcaaggagatcgggggtgctgagttggccaggagtgactggggtgaccgggggtgctgaggtggcctggagtgccggggtggccgggcacaccttggttcttgtagacgacaaggtgacccgggctccgggcgtgagcacgaggagcaggtgcccgggcgagtctcgagctgcacgcccccgagctcggccccggctgctcagggcgaagcacgggcccccgcagccgtgcctgcgccgacccgcccccctcccaacccccactcctgggcgcgccgttccggggcgtgtcctgggccaccccggcttctatatagcggccggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggtgcgctgcgtgcagcacccggcgcactggcgccgaagggcctgggggttgctgggtgccgctgcgggagactccgcttttcttctcactggagataatatgtggggaaactgaaggcgctccgggaaaggtgaaggcggtcgccggagggaccctccccagccggccctctacttgctcgattctctaagtgcagagtacttgtaaattgcaaagcgctttcagtgaaaatgggttaaaggtttccggagctgaggggagcggtaccgatgtttagctgttggaaagatcctggacacaggagattctcctcgccccgcacgggggtgcacacggactgcaatcccagggatgcttggggatggggggatataggcggatttggaccaaggaaggtgggtaggcacgttgtaggaaatagtacctctcttttaaaatactgactttgcacagccttttggtttgcaaagcaatgtctagtcccggtatgtccaaaaacaagtaaagtggattcgggttttgatatcttctgcggttggaaaacctgaagctgaaaaagaagtaacttcttaaggttacccagcggccacaacagagtgtaggtttgaactccgcgtgccactttcagtaccataccattcttacaactcgggccacccctgcacctgcgccgacctcaaacaaacttccaggtgcgtggtgggtgcgggcaatgtggactaagtcaatttcaatgacacggcaagggaattggaatcagtcctagggctgtctcccttcttaatctgaaatggggggggggaatgagatgttgttaaggggagccccagaagaggaaaaatgcaaacatttggcagagttaccctcttggcttagccactatcagtatcaggcagacagcgactctggtaagggcatcacattgttcccttaaaaaaaggagcgggggttgtttaaatggatttggcagctgttctttcaagcattcttagccagcctcacctagttatatgagaaataaagttcctgccttgcacagctgaaggctgggagaattctccccatcctaattcccccaactccccaacgatcacgttggacagatgtcactgggcaggcccccatctagggctagcaggatgaacagtccctttataatttatgtagctgtagagttccacgcccgggtgaagttattttctggctcggcaaggctggctctgttcacccctgagaaatgctggattcatggaaaggcaagatgcctgaaacatacactggctctggtcagctgttaaagctgctggaggcatttgtctctcggggcaaagttatgtcatttgccaagtgtcgtacattattgtgcattttggggtattcaaaaagtgatcttagaaatactgatacacatcgtcattcttgggctttagcaatcatcatgattaccaccttagtagcactgtagtataggttgatgtgagttataagattataaaaagatctaagtgacttctagaatctatttgacaaaaaaaggtaaattttcgacagtcaaaagtcacaattatctgttgcttaaatagaactgttttgtcttcatgccctagtctgcagcccaggcattaagaagaaaccaaggaaatttaagaaattactcaaggttcttagaaaagaagtataaatacgtttatttacatgttcttagagtatttacattcttagtatctcttttatctcagtatttccttgaaaaagaaagcaagctaagattaaaagaaattgaaaccaaatcctcgcaggtagggacctcctctgtgaggctctgtgctggaccctgggaatgtgtgcttcccaaggtatgaaaccccttggggaactttacagcaggacctcagtgagctgtttggcaggtgaggaaactaagacccagagaggagagggactttcctaaggccctggtgagtgacctgccagtagccacttccaggggagagcagagcatctgcagccaaatcattgcagccccaggtagctttctagaatagactgtggaccagatgggccacctgagctccctgctagggttacacattatagccctgtttgttgtagtagagaaatttcatgactctcaattgtggacttaagccgatgcctccagaccttggcatggtccacaggccctgggagcatgggctctgaatgtagcctttgatccccatagcggtcttacagcccctccaagttcattctgaagaaggaatggagtgagaatcctggctgcagatccagtcttgaatttagtcatatacttaaaattccaattcaactgttaacattccagcatccattttaagcatcagactttcttcatttagcactttttattataaaagggagatctgctggagggggatttctcctaccccacccccacccagggaaggaaaagctctttggcacttagaagtctgagccgtgagtgggactttggcattgtctgcatccatgtgctgctgtgttcacccggggtgaaaaggactcacttaggcaggcaccagcaagatgcacagggtctgtgtagaccttgagttttagagatgtaacggggacctagaaaacaagccaccaacatgcttgcatgattctgagcccctgaggcaaaacgctttgcaggtaataattcagttttcccatctgagctggacaccaagctcttataagcgtgtttacctggtagcattgaggacggtactggtcaaccttggaattcccataagggcttgttacaactcagactgctgccgccactccagcgtttccggagtggagaatgtgcatttcttccaagtccccgggctgccgctgctcccgcgggtgggaggaccacacttggagttgactgcaaaatttctgagccggcgctgcagcagcctcccgtggctcaggtctgccccctgccggtggaagatgaagcatactgccttcacctactgaggggcactgaagcgtttgtctgccttctttagttgcagctacttaggaagagcacctgtcagattgactttcaaacagataacttcttgaggtagagcaaccaccatgtagtgagtagtatgatggaataatacttcatcgaggtatttaaaaaaaaaaactcacttggattgccaactaatattgtcatttacatgtgacctggttgcaacgttaagatttttaaaagactgtgatagatattgatgactctcatgtgtttgtctctcttgggcgttttaaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactcttaaaagcatatgggatgtcataaagacctctgcagataatgaaaaatattctcataaagatagttttatttacttcatcctctatgcttgttgacctgctattggttccataccagcttctgtgccttactctgggaagagcaaaaaggagacagggagtgatggttagcttattcgggggactttcgtgctacatcagacataaggtatctgaggagcaaattacaggtcccacttttggtagttgtgcagcatcgtaagatttttaaagcacacattctagagtaaaaactgtgactctgttgctctggtccttcctgatccccagggtccctgccgtagagaaatggaagacacactgaatcacctgaagttcctcaatgtgctgagtcccaggggtgtacacattcccaactgtgacaagaagggattttataagaaaaagcaggtgagtgaggtcctcagtgtgttttcttcctcttctgttgacacagaggagaaacccatctcaccagcccccaggctcttctggccatagctctaactctgagcctgtgcagcaccagtgcccaggacttggtgccagtctcaggaggtcagaccaagggctgctttgacttgttgctctgagtgctgctatattggccataatcctcaaccctagtgcctttccaccacccgcttcccactcctgtcctttcaatggttcacccacagggcggacaagatgctgcccagtggcaccctttataaactgcaagtggacatgttaacacatttgttaatgctgcgtcagggagtgacatttcaaacaactattatagtcagtttccaagaagtgtgacatgaggtcataccacaaaaagcttaccctgaaatcccacaatcgtcccctttcctactgatgccttcccgatagtgagcaggttgcaatattaagattttgaaaaggctgttgctagatgttggtgactcgtgtgtctctgtctcccttgggcttttcaaggaaatgctagtgagtggggggatgactgcagcatggccagcttggagagcccagccatccccagcacataccaggtgtctgtcttggcgtggaggggatggaacttgaaatcagacactcggtccatgctggggatggccagtctctccaaactggcatgtggtcttcctccgagtcactggcatttccctagaaagtccaagtgagaagaaggcatgagagtcatcaacatcaaacaacagtcttttcaaaatctttatattgcaacatagtcccattcctggaaaaggaatggagtgagaatcctggctacacatcagccccaaatgtagtcattgcctaaaatcccaattaacctgaaaatgatcaaacaaatttaagatatagtaatattaagctgtaataaatatgcttctataggctttgtgttatgtgatggcactatttcaattggctttctaattggacaattgatactatgctatctacagaattggcctttggagacctaagtgagccacagtggcctcagggtgaccatatactaggattcatagcagtggccacagtcagaaagcctaagctttcctccattgccattgctcgtttatacccacgttttctgtcaaagtcatattcattcaacaaagtcatactgagaaggtgtcatgtgaggctggatgtgggctccaaagtcatagctgtgacattcgcaggcagcggggatgttctcagtcccacatttggcagagaagtcagtcaagaggttctacaagggctggtgtccaccttatactcctagaaacacaaaactgcccccacccccgctttcttggagcaggaagttacacccacacgcatgcacaggcgcacactcagcgggcctaggcacgcgtggctcttgtgttgccttagctgaaatttctgttgtgctttctcagcatagcagagtcacgctggcaaaccatcatgcgccctggccaccgacctgacaccagacccaggagcattcacttctctgtcttctgtttctctcccacagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatttgcatgtttagttataagggtttcttttttccttacaagttggaaaaaataattctaatttaagggtaactctttgacaatgaacactgtgagcagcatctggtactcgttgctttgtttgaaaacatgagttgagaccccagccctgcacttgcaggcctagtgccattagcctgcaggctgtgctggatatctcagggcaagagtcgagcccttttgattttggggggattatttcaatatatttctttttctttttgttttagttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaatattttagctgtagtggaaaacttcataaccacaaatgtttccctgctttcccttttagcaaaagaacccaagtcagtttccatggctttgtgggaagcctatggaggcattgggtcatatctgcaagatggtccaattctaggaggttgtgttgttgggacagtctgtggcccaggtttgatcaggtcagcaatgtgcacctatgtgactggtccttgccttttttgggttgtgtcctgtattgtcccatctaacactagcagccatccacagacaagcagggaaggaccagaacagacactcagcaattcagtctcgtgtcctttaccgctttgtccccttcccatctccaatcagagagtggcccttctctgctccaagcagaaggggttctgggatctaagccccctcatctgcagccttggaagaattgttacttgtcaaagccactttagacaaaacactgagcctgtggcttcagagcatccaaggataaactgcagtcgaagagttacctcctgtcgagttacctcctgtctagcgccatgtctgatttgttgatgaaacatctaaaatgatacccttatcacgtgttgtatgtgatgagcagcaagccggttctgtaagtgttcagaggactggtattgtggtgtgtggtctcaggctgatcacatgagaaaccaggacaaatgagaaagcaggccccttgggggtgctgtgactgcaaggctgtgaggatggagggagacagtgagcagaaggagcccattgcagggagcaggcaccaagcgtcacggagagttgtgcggcagaatcctggagcacctggggagcgaggccaagtgtctggaaatccaggaccggaacgtggcaacctcttgggagctgctgaagagctatgagctacaaaataatgcttgccttctaagcccactgggtttgttttcctgggagccaccaactcatgtgccctttcttgtcctcatttcttaacctctaacttctgctgcttcccacacttcatgatgattaattctatgtgtcaacttgactgggccatggggtgcccaggtacagcatctgtgagggtgatactgtgagcgtagtatctgtgaaggtgtttccagataagattagcatttaaatcagtggactcagtaaaatagattgccctccccaatgtgggcaggcatccatcgatccattaaggttctgaatagaacaaaaggcagaggaaagaagggtttgtgccttttttctgtctgcgtgggcagaattgcaccaccagctttcctggttctccagcttgcagattacagatggtgagacttagcctccatacttagccaattttttgtaataagtcttttttggtgggtgattagagataagtaggtagatagactagatagatgatagattgatagattagatagataggtagattagacagagatagatacatagatgatagatagatagatagatagatagatagatagatagatagatagacagacagatagatataacctgttagttctgtttctctgggaaaccctgacacaatacctatgatcaactattccctctaaatgctctcctgccacttccagtaaataccttaaaattgcatactctcattctcctctggaccctccagttcttctacctccctgccttggttctgatcctctgccatcttcctcaggcaacttctgctccctggggcttttgcttccactaacccctaaggtcacatgtacccaagcaacctgcacgcagacacacacagaaatgaacaagtaagggtggtctcctccatgggagtcaaggtgatgcaggtgctacaacaacagcttcctaagattaagttatcaaatcaacacactttaggaaaaataaaaatcaccattgttgatgagggtaccctaatgggattccaggttctctgctgtggcagcctgtctagagggacatttctgatctgatcaaactccttgaac

SEQ ID NO: 14457 - DNA, 60095 bp, Human; identical to SEQ ID NO: 12419

SEQ ID NO: 14458 - DNA, 5788 bp, Human; identical to SEQ ID NO: 12498

SEQ ID NO: 14459 - DNA, 10917 bp, Human
  misc_feature (1)...(10917): n = A,T,C or G
tcttattttgtatatatctccgtatatacattctttttataagaaaaggaatatactaacatattgtttactggattgctttctttgattacatagttgggagaatttttcatagcatcatctacaactggactctgtttttattagctatatactatcctattacatgattgtaaaatgaaatctcattaacagaatatgaaaatacctgtttctcaacatattcattaacaactaatgtgatcaaaatttcatatttgttgccagactgtcatagaaaagccagtgtctcattgatcttctggtttgcattcctttagttatgaataagcatttcttcatagatttgttggccatttccacctctctctctcactctacctctctctccctctccgtactcttcctagaaagaacttaattcttatagattaaggctttggtcccaactacaatgttagagactttgggagatgtgaataagagtagacattttactgagaataaattttagagataactataagcatgaagacctgaagaagacaagtaaaagagaaatacttgaataggctattatagaatgaaaagcacaattcacatacttcccaagagtgctaccctttggccgaggtggttctgtcctggacttcagactttaaagagtccttctctggctctcctccagccatgacccacccccataggatgattcaataggtccagggtacaggcccagagctgctgtctctctcactccagctatccaggaccccagaaatctctgtcaactggccctgagatcacctttatgtgtctatcctcttgaagactcaaacagccaatactgtgctcacttctaggtctcaatgaccaagagaggggcagtttgagagatccatgtatgaaaagaacatggacggtatggactaggatatttacactcatgcacgcccgaggtccctcgtgacacaagatgaagccagggagtaggaagagaaccaggggtgaaccacaggggtcagaagcctctgtttgtgctcttgcctggtgtcctacaaatgtttatggcaggcatgcttcccagaagaacagaatttcctagtcactgtcctcaaagaggccatgctacaggaagaaaaggaaagagtaaacataatgaaatgcttctctcttatcattattttagtcaattcactattcaattgattcagtttcagaatcttttatgtgccaattgctcagccagacactgggaatatcaaagtgaataaaatagggtcctggcccctaaggcatcccagtttctcccctgtttaaaacctttcagtggttcccattgtcctcaggataaagtccaaactctttttcttatggcataaaggtcctcaccaacacagccttacctacctaggtaggtgaatctcccccttctccttactccccactctgctccagccacactgagcttttccaccaaatagcctatactttcacatttctggatctgaaaatgtcctcccagacacacccctatgtccaacttcctatttccaatttccaagtctcagcttaaatatcactccctccaggaagcatatctgacccccaaacctgacccctgtgcttatcctaccatcattattatcacatggtattgttggctattgacttgcctccatattgaattagatctttgagaatgggaactacatcccattgagctacacttcactttttaggacagagcctggtagataggagacaatcaatacagatttgtgttttaggttattgcatgcttatgggttagctagggagctttctttttatctttcaggaaagaaaccaaagagacagactctccagcaggcagggggcgccagtgagtgagctaggcatagagtcttgtggagagaattatggtgtcatagaggcttagaatcttggcattagcagggaagggaacccatctggttcagaaggctttggcttctgatagtcatggactcactaggctgctgaggaagatcaataatacctactggaatcagtcatgagaagtcaagcatggaaattgtgaattgtgtgtgtggccagaccaggtaacacagagaaacattgtcttttgggtcctctctccatggctttttcatgtgttcattagttcattacgtatttacctactgagacccatgcaatgccattcagtgtgttggatgagaggattccaggattcatcctatctttcaggaaaaagctcctgcttctatttaagaggaagacatgggagccactgggggtggggatagtgagaatgcctgtgtttatggaactaacagaccacaaaagtgagacaattgggaaaataataaccactataaaaatgtaatgggaagtacaggggatccaagaaagcctttcagggagatggaggttttgggttaaggaagttttcctcgaggagtgatgtgtaagcagagacttcaggtttgaacgatattcagtgagcatgtggggacagagacccaggaagggtggtttaagctgggaaagagcacattcaaagacctggaaagaggtgagaaaattcagcaggtgtctgctctgagccagtctggtgcctgagggaacagtgtttggacatgaggctgggcctgtgggcagagggagaaggtgccttgccagagccctcctggtggtttgggctctgtatcaatcctctctgaatagagcaataagagctaggaagatggccctggccttgcaccacaagtgtttgacatgattaggcagatttcctgaggcaggctgtgcacagcatggttgggaaggaagggaaatggagcttggagagaatatttatttatttgtttgtttctttttatttatttattgagatggagtctcactctgtcacccaggctggagtgcagtggtgaggtctcggctcactgtaacttctacctcccggattcaagtgattctcctgcctcagcttcccaagtagctggtattacaggtgcacgccaccacacccagctaatttttgtattttcagtagagatggagttttgccatgttggccaggctggtctcaaactcctgacctcaagtgattcacccgtcccagcctcccaaagcgctgggacaacaggtgtgagccattgtgcccggccaaggagagaatcttaagaagaaactcttgcaggaggcagaggggtccaggaggcaggtttgttggacaggagccagggttctgaaagtggaggatatagatactattcaccaggcagaaggaagacagtggagacagcactggctcacaggggcaggacctgcatccatgggggtgaggttgcagaaggacttgatgttgccctccctatgctacagtcaacaagactggtttccaacctgctgtccttctctgatattgcacaacctccacattcaggacctattcccaggatctcactatgggggacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgctgtcggccacacctggctcaatgggacccagtttgtacactaatgaactggatttaggtgaatccccagataaaaaagggttgagtctaagagcatgtcacccatcattcaggatagccacagccctgggtcttctataaagtcacaagggtgattcagatagcaaagtaggtcatctaacaggcgtcctttagcaaccacctgactggagaatcctgcacaccttcaggagaggatgatacagatttttgtcctactggggtggattagtccatttccacactgctataaagatactacccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaagatactacccaagactggataatttataaaggaaagaagtttaatcgattcacagttccacatgtctgagaaggcctcaggaaacacaatcatggcagaaggcaaaggggaaggaccttcttcacatagtggtgggagagagaagtaagaacaggggaaatgtcagatgcttataaaaccatcagattttgtgaggtacatacacagagccaaaccatatcatggggtaacccccagaaattattttattttattttattttactttattttattttttgagatggagttttgctcttcttgccaaggctggagtgcaatggcacgatctcagctcactgtaacctccacctcctgggttcaagcgattctcctgcctcagtctcccaagtatctgggattacaggcacctgccaccatgcccatttttctattttttgtagagacagggtttcaccatgttggccaggctggttctgaacccccgacctcaggtgatccacctgcctcgacctcccaaagtgctgggattacagacgtgagccactgtgtccggcccttcccccagaaagactttaatgtgaggagagatttgtagctactgtccccaggagtccctttatctacaggacacaaaagaagaggacaagacaagagatgtggctttctaaacatcagggagagtgtttggagcagggctgtggggaagcagcctgacagcaggtcaggataggatagagggcaagtagggagcacccagcaggagagagaaggccaggacagaggctggcccctactaggagctattcacactggctctaactgtaaagactcatgagaaagttcaagcaatctcaatttgttaaacagccatcatcacaaacctcaagttcttctctccatgtacctataattatgcatggacacatgcctacatgcacttaggtgcacacacacacacacacacacactctcacagagatatgggcatgtgtgtgcttagtggaaagcccacagcagtaactggctcagtttaaaaaacaagtttgggggctgggacattggctcacgcctgtaatcccagcactttgagaggctgaggtggtcagatcaccagaggtcaggagttcgagaccagcctggctaacatggcaaaaccccatctctactaaaaatacaaaaatttgctgggcgtggtggtaggcatctgtaatctcaggtactccggaggccgaggcaggagaatcgcttgaacctgggaggcagaggttgcagtgagctgagatcgcaccattgcactccagcctgggtgacaagagcgaagctccatctcaaaaaaacaaaaacaaaaacaaagaaccactaatttgggccagaggcttttctcacaatcccaaggatgccagaggctggaaggtggttgccacctcacctcagcagttgtcactccaaatcccacacccatcctaccctaccagtgacagggctctgacaggcctggcacctccctgacatgggtttgtggctttgtgagctgagtccacagagggggtacaggctcatttcccgtgcttctacatttccttgaggaggctagataacaacctgctcactgtctgctgtttcctggccacttctagaccctctattctgctctgggaccacaacagtggcgttcatcctctcatcatgtgccataggagggaccagggcggaaaccattaggggcttctccaggggctgcatacctgggctgaggcccagggacgttcccagaagagcttggacttcctgggaggaggaagatgggtagatagaagtaaagcaagagttgtttggattttctctatacctggaagaatcaggaaatgataaaactgctgagtggttgagtttgaggacacctaccaggtccagttcccccttcctcacccccaccactgcccctttatagaggaagaggtacaagcccagagagatgaagagaactgcacaatcccttaggcttgggagttgcagaaccaggcctggaactcaagtcctgccatgccaagagcactgtacttttcatttcatcttgctgtaaccaccacagtgctccgtgcatgggacaaaatgatgcattcaggaagcgtgtgacagttggtcactctaagtgcaagagtttcattgcacctgggtccatgggtgccacattagagacaagaacaagcacatgctctggagtgggatagagcttggcttgaatcacttacaagcaactgaggtggatttttgaacttcagtggtcctcatatgaagtgaagtggactaaaaatgtctacctcaggctggtagccgttataacattagctgatgtttgtgaagtgcctgacacttgactcaggatctggagactgagggtcaaactgtttgctcattagctaagggaccttattcacattgcttacatattctggtcttttgattctttatctgacaaatgactacctagtaaggaacaaacacactggcatatgcaaaggtagaattatggggctggctggcctctctgagggatccagctctgctttctcaaccctggtctgagtcattatcctgaagatggatgtatttgggtgtcaagaaaggaggaaatgaaagcaggcacccagatttccttctgatgagaatattattttctttttctagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaacattgcctccgtttgttcctttacttacttgtgaaaccatctcaccagcctggcctagagcccaagaaaatattatgggcatgtcctggaggtccaaggagcaagaactagcatcctgaagaacaaaacctctgctgagctggagtgtagttgactgactcatcttggttttaaaatgaaagtcctgcattccaggaaccccttcagtccttattaaaaaaaaaaaaagattattggtcactcaaagtgcaagaatcctaattcctctgggtccctgggtaccacattgcactccagaccaagcaaaaatatgtaagtcccttggagtgattccacccccgcatccagaaattttagatggaggtagagtccccaggactcagcaaagcacagtggctagcggcaaagagtgaaatcttccaggatcagcactggctcctcagtcacagagtagcaatcttaaagcaagtggttcagtgtttctgacactctatttcctcgtgtgtaaaatgaagacaatggtacttccctcaaagatttttttatgagaattaaaagggataattcatttaaagtgcccgacatagggtctgacaccgagtggctattcagtgtgcatagttttcaaactcctctcagccacaaggccctatttccctctaaagaagacatcattctccaataatttgtccccaagcacacccccactagtccaggtagacaggtagaaatagagaaatcagcctcattaagcacacttgtaaacttccatttttactgctttttgatgtgtaattaacatatcacttttaaaatttttcgagtgcacttctgtactctctctctcatacttctccctgtccaccaatccccagaaaactactggtctacttttgtcccttcaaattagtgttttcaagaattttatgtaatcacacagtaggtttgtttttttatgctgagagtttattatttcaaagcaggtcttcccctacccactaaacactgcatataagaagaagctcaaaactgcagtttctattttggtaccatctagggtctatgaaagtcattttcaattacttggaatttcaaaatagagattccctagcaacaatgcagcggtggcacacaaaatattcctgcactttgtttagtttgtgggagaaattggaagaatttcatagtcttacaaaagttatgttggaagtagtttatttttccctctaggtgggcaggcagccatctctccaaagtttttgtgaatgctaaggttcagatttcaaaatgtaaacagattttcacgaagcatctaaaatgggccactctatttctattctgggtcatggcaactctgagttattttgtattcccacactgcaaagggcaaaaccccattccttgcatgtaaactttcaggagaagtgatgcagcacgattttaggagtttcttgaagtagctagcgacctgcaagttcaggtcattccaagaatctggccagatgggagaaatcttgagatcttgggctcctgaaggcttcctcgtgccccatccagctggtcctgggggattcgtggttgctgcagtagttggagggttgctactcttcacagcctgggtggtgggtgccctgctctccaccctgggagcctccactggctgtcatgctccagggactactgcggttccaaggcgagacctccaccctcccatggcaccagcctccaatttggcatcgccccccaactcatcggtggaagccagtgagagtcctgctacactgggcctcaccaccatccccaggcccaatgcggctgagcaagatcttggtagagctgggctttgggatctgcaccctgtgcaaggacagccgagatgagctgactcacccgcctttcccttgctggggtctggggaagccagtggtaattacccaaccctctgtgaaaggcaaggctatgggtctgcaggaatggtgggaagaccctgcccagcc

SEQ ID NO: 14460 - DNA, 29970 bp, Human
  misc_feature (1)...(29970): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacggaatcttgctctgtcgcccgggctggagtgcagtggagcgatctcggctcactgcaacctctgcctcccaggttcaggcagttctgcctcagcctcccgaatagctgaggctatacgcgcgagccaccacgcctggctaatttttttgtatttttagtagagaaggagtttcaccgtgttagccaggatgctctccatcttccgacctcgtgattcgcccgcctcggcccccaacgtgctgggattacaggcgtgagccactgctcccggcctattaactcaatccttagaaaaacaaatgtggcaaaggtggaatcatacaacatatggccttttgtgtcttacgatattcatttttgcatctgaatgttcaaactaaataatatctaccttgtgaggccatctgaatcacttaggatggtccttggcaccaaatttgccttcaaaaaagcatttgcttcatttaatttcgatttattcacgaaggactaaaggacactgcaagggcggggagggagtgtgcgcctgcgctctgcgcctcctagagggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggtaagaacgctgtgggccgggtggaggctcgatgaccgctggcccgctgggcccgggcttgtccgccccttcccgacccgaccgacaccgggaccggtctgccttctccttcccttccctcccctccacacgccaggcccgggcacctcttcctgcctgcccgccgggcccgggcctgtcttctccccttccggccacacgccgggcccgggcctacgttctcgccttcccgccacacgccgggcccgggcttgtcttttcctccccgaccctcctcgtgcccggccgtgggcctgtcctttcctccccgaccctcctcacacccggctcggacacctcctgctccccgccggccttcccctctctttaggtgtgacagctccaagtttcctgtttctctcgcctcttgcttggatgtggggcgaggcgaggtctgttttgccggacgggcacagaacataatccatttctagcttgtcaggtggaaatgcaaagaagatattgggtttttttggccctctgtgtgccaaacacatactgtcacatttaattctcccaataatcccgaaaagtagcttgattatctctgttttacagctgagaagagtaaggcttgctcattcattggttcattccaccagcaatcatttatttggtgcctgtatgttcaggatgttgaggatagcaatgaaaaaaatggacacctaattctcatggaactaaattcttgttgtggggaaaacaataatcataatcttacgtggcacgggatttaacatggaatgatgccatcaagaatggcagaagtagaatgacagaagtcagagtgctgaatttatctgaccccaaaggcagagcttttttacttttaactgtgcctttttgtgtcactttctaatcagggtcgggttcaccacagtaattgccttttggatggacttagctttccaccacgcacttggtaatttggaactaagtttatagagactcttgagttacttattggaatgaggatggcacaggaagtcatagttggcccatttttataccgagatcctagtgtgacatttccaaactttaaagtacttgagaccgtttgagaaagacttaccctaaggatgcagtggcttaggcaatttacttggttttctcatttgaagatttgctagcttgcagatttgttcagataagtaaatgagattatgtatgtaaagtccagcacaataacgttcctttcattttctcctttcctgccttccagggagcctttgtccttgggtctctaaggaaaatcctactctttgaaagttttgtggtagtttttatctaaataaatctctacaattacattattacctttgtgcaaacaggcatttcggaaatggaaaaacatgttgagctatggaaggggaggaagatgtccttctcaaagggagagaagatattttagaactacatagtacccctcaccccccccttttttttttttttattaaatcagtatagctgtgccagaatctcaggatccggtgtaggggtttcataaaactccataggatatcctgacacatatccctcccccggttgagagtccctaagttagtgttttataatactttccctcacatagtgttagcattcagagccagtcattgctgctgctgatggactttgaactcagtctcttatttcaaagaattagtattttctgcttggttggtgaatctatgacacgagttctcctctaggtggcaagctcaccattgtgttctcagggactatcacagtagtgtcagtttaggtactcaataaatagttgttggatgaatacataataccttaatacttaatgattccttcaacataccaggtgtggttagggactttggactcagatctgggattaaatcttggctcttctacttgggagtttgtgactgtaggtaatatatttaaccttgtcaagtctgctttttttttttttttaattaatggtgatgataatagccactttaatgagggctaattgagatagtgagttttttaaaaaaaggctcggcacatagtagactagatgtaaatacttactgaattcatttactcagtaattaattgttgaacacctactatacaacagtgaacaaaaagacaaagtccccgccatgtggaacttaccttctagtatgttttctgaagggagatcagaaaataaatggttgctacgtgccagactgtggttagtactatggagagtaataaagcatattaagggggattggaggcaagacttttaaaaataaaagatggtgaggaatggcctcaatgagaagatgacctctgagcagacacctgaaggaagtgaaggcctgggctcgaggatacctggaggaaagcgcaagggccctgaggcagaagcatccttgttaagctaaaggagcagcaggaggagaagagtaagggtagaggggaagagtaggtagcagtcatgaggtttctgcaagagtcctggagagagatgatggtaatgaaattgatgaactttatgtctttctttgttatatcctgttctttgactaaaagtaataaaaataggtaatacttctatagctcttaatgtgcatcaggcactattttaagtgctttacatatattagtcatcagatctttccaagaaagtatacctagcctcagaaaatgaagatttgtcactctttaggatatacagtggaatgtgctgctggttcagagagcactttctcaagcagtactgaaatcagcagtgaattcactgcctctgttcacatactggttaggttgcaaaggcaagcctaaagtgtcgataacagaccacccaaccagtatgtatgcattgggttaagttcagtttcatggaagaactgtagaaggccatggcattttttattactcttcttgctactttttagtccttttaaaattttcatccaaggttttcatcttgactttgttttcatacagttatgtctggacacattgcttcaacatagaacgcacatgaacaatgtggaggtctaggctggaatgggggcccagttgaccacttttgctctagctggtaggcattaatactatctccatgcatgtcagttagaggagctgccatattgtccttagcttatcttctttgattgttaaatcataacattgcaatgcttaacttctgatatgaatgactacagtcttaagtcttaatcattcttttttttttttttttttttgagacggagtcttgctctgtcaggaggctggagtgcagtgggcgatctccgctcattgcaagctccgccttccgggttcacgccattcttctgcctcagcctcccgagtagctgggactacaggcacccgccacaacgcccagctaattttttgtgttttttagtagagatggggtttcaccgtgttagccaggatggtcttgatctcctgacctgacctcgtgatccgcccgcctcggccttccaaagttttgggattacaggcgtgagccaccgcgcccggaccactcttagtcattcttatcccaagttgtcatccctaattttgcttggcttgattaatcaagatgttcctctttggggttagcagtgtgtttgggggcacctttggggcttaatattcctcttatgcagcattacctaagtgctctacaaatatggcagtttggttcagtgaagtagtgagtagctcacaaaataggttaaaaggttttgttgtcagtttggtcatgggtgagaagttaagtcttttaatactgagacaatttcagctttcaaaagaagataatctcaggtgtgttttgagctttattttggcattattgttagtcctctaggctttaaaggagggaaaatattaatattttatcacttgttggcttctatggggagaaccacaaagtgtttgccatataaaatcaggataaaatggcattattactgtgatagtaggtaagttaacatattttcctatccttgactctattatggcaagaagtttcaagttgaatatagtccccccaatattcaacttgaaattcagttagaatttctgtggtactgccaactctgaagaaaaaatccagagttggctgtaaaatacagtaaatgtgtcccctttaacccacaatcttgctgctatttgtgtgaatccatgaagctgagctttgtggttctggcagcaggaaagacactatctcagcacttattctgggatcatactttcagtggcaacacccttgccagctttgtcttgtttgaaaaaagccaaaagtaatagttgtgctagaaacattttctttctctgaaaaaaccttcctgcattaatacaggccttagtgggacatcaagttgattatctatgtttaaagcagaactataccatacttactgtggctagtctgaacctaaacattaatttatcatatattcatccgtttgtccaaaatgtcttaggcctctgttgaatttagggtgaagcattgtacaattgccagggacattttctctttatgtcgattcagtggcacacatagaatgtgaacggttggtaatgacaaggtactgataccaggttgtctgcttagtattaggatgtacaaagctattaattcataaataagacatggtttcttctctcatggagccctcaggctaaggaggcaggcatgtaacaatagggtaacatatgttacaggcgtcctgccggaaacccatacagattacagtggtaatgcaggagggagcagccaactctattggccaaaagtattgaggagtgaggtgctcagtcaggaaaggctttgtagttagtgatggtgacttgaaaagcagataggtagggagaagaggagagactggcattgctgacagaactggcatagccaagctgcacaagataaaccaaactatcctatgcatagaaaagctgtccagtagattagggtgtgggagctgttctgggagacagcaggagagtcagagtgaggccaggaaatagacagctgtgatggttaattttaggtgtcaacttgactggattaaggacatctagaaacctggtaaaatgttattttggggagtgtctgtttccagaggatattggggtgtgaatccaagtggattaggtggggaaaatccaccctcagtgtgtgtgggcaccatccaatctgctggggcccagagagaacaaaaacattgaaaaggcagatctatttgctggagctgggatacattcttcctctcctgtctttggacaacagaactccaggctccccaggctttgggcttcaggacttgtatcattggccccctgggttctcaggcctttggcttcagactgagagttacaccatctgctttcctggttctgaggcctttgcacttggactgagccatggtactggcatcccagggtctccagcttgcagacagcctgtcatgggatgtctcagcctgctaatcacatgagccagttcccctaataaatcccctctcatatctatatctgtatatatctttatgtctatatctatgtctgtctatataatgttccatctctctggagaaccctaactcaggagccttattgcctttaaaagaaatttggactttatcctgtaggcaaatggggagccataggagagctacgctgctttagatgagatgatctacttgggatggttggttgttgttttgagacagcatagaaattcttgaagcagaagagaggtaaaataccttatgcatttttcccctttagaacctaaacattttataaagacacaagggcaaatactgaagcataagggagtaaaaagctacatgtaaagtggtctgagtgcagaattttagatttttgtgattttctttctccttagtctttttatgtttatgtaatatttaataaatcacatcattatagtaacagctacagctggcttgaggagagaaacacaaatgaatataactgtgaaactcagtgaacatatacataggggagtagctgaagactttactgtgctggggcgttggtcaggatcttttagagagagaacagagaccgttggttaagtaggtgacggccaacaaagtttctttgtatttacattgtgatcagccatttttcagaggcacataaaatagatgaaagttcctgacatgagttatattttaatagaattccttctttgttgccattgatgtaaattagtacaaaggaccataaaattgtaactttagtcattcagaagtatgtctgttttttttgtgtctttacgaaatgtattatccaaggagggcttttggaattagggagaaattttcttatttttgataatgaatgcctggattggggtcccagaaattgtatgcatcacagacaaagcaggcacttccactctgttcatctgaaatctaagggatacttaatttagggtaatggctccttagtgttcccctttggtgtttctcatgtgattttgctttactcttaatattaacaaaaacagctttatatgcatagacaacagcaagtattttacattcaaaaaatcgactgaaaggtaatagaattacaacattgtctagatttcatcttttggcctgattgcatatgcaggctatgaggattatcttggagaaaagggaaagctagaagtaccataagcatgatagtcacaggtaggtagggctatattgccaggcactgtcctaaacattttaattcatgtaattcattatagttcatatataattctcattgagttgggcccattatcgggtggagcaagtggggagaggagaggctggagaggagccccaggtgccatccgaggtccttctagctggccttaccctgggggccgggcgggggcagcaggcgtctagcagggaggcccagcggggagggagctgcaggggggccgcgagcgccagcggggactggctgggagcagggcaacaatgggcggagttttccgctcctccccgcccttggcttgagcgctccagctcgctagtggcccgggcgaactggagttgccgtgtgacgcgtgggcgggacgaggcccgggctcggggacctttcgcactcgggtcaggggtaaagcagcctgtcgcttgccgggcagctggtgagtcggtgacctggcctgtgaggtacgtctggcagcccaggggccgtagcgggagcccttgaggccggtagccttgcagggctggcgccgggcaggagccgggtcgcagcggctgactgcacaactgcgtgcgaatcggcgaccggggcgagggcaagggctcctgaggccgcttggaaagggcttttgggaagtctagaaagccgcatgagtcactgttgctttcgtattagaaatgccttgttttcgaattagaaatgccttgcggtcggttttcagttactactttagaaaattgatgtgctgggatttattgccctcagttgcttgtataaaggtggacaaatctgagcctagtaaactctgaagtgttaaatcttaaaatgttcaatagtgaatttattattatcttattttaaatctgttgcgatattaacgtttgtttgtgtggttttaaaaagattacagagaaccagattctggatttcagaaactgcttgtcttgataaggaatttaaaatgggctggggctaaggtaagatgtatataatccttgagttaatgagttgtataaaaaacaacctttaggccgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtggcggcgggcgcctgtagtcagtcccagctacctgggaggctgagacaggagaatggtatgaagccgggaggtggagcttgcagtgagatcgcgccactgcactccagcctgggcggcagagctagactccgtctcaaaacaaaaaaaaaacccaaaaccaacctttaaaaaaaagacggaagaaagaacgtgtgaagtgaaaaaagtctcaaggtaaaattgcaaaatattttttaacataatttttttaaactaaaagctttacagacggtctaatgcaggttgtctcatcaaagataaccaaattgttcagttagtatttcgagtgtagtactcatagaacacataggtatcctgtggatagatgctgcgcttggccttttagcaatgactaggatgccaggcaaataagtaaaaagtagaggtctttggaggggcaggggcaggtggcaaggggggcagagaatgtgagagttggaaggtgaggttacagatgatctagtctgagctttcattcttacagacgaatgaagcctggagtggctgtgatacagacgttgaatcaaaactatttgcattggtatttggcagtgttttggtttttctgagcctatcatgacatacaagggtactgtttatttatttatttatttattttgagatggaatttcgctcctgttgcccaggctggagtgcaatggctgcgaccttggcccactgcaacctccgcctcccaggttcaagcgattctcctgcctcagcctcccgattagctggaattacaggcatgcgccaccacgcccggctaattttgtatttttagtagagacagggtttctccatgttggtcaggctggtctcgaactcctgacctcaggtgatccgcccaccttggcctcccaaagtgctgggattacaggcgtgagtcaccgcgcccggccagtactatttttgttagtgttatccaaggcagaagattctgaacaattgtggttataatttactgaggactatgaaaattgactgaaaatcttaacggaagttatttcaatagtaatccattggaatgttaattttaatcactagtgttggcaagtaaaaatactttacaggtgataatacactaaaggaagaacaagctcatctgggagagagaacccaggactagaccttggaaactgtagttctaaacccaaatcttaccccttctggctgtggcccttcagatgggtcacttaaactatctgggcttttgtggcttcatatgtagaatgagagtgttatattaaagagatgaccaagattttttccagctttattttttatttttttaaagaggcttgtgaggagctatttttcagctttaaattgtagtttgtgtgggtcacaagagttaaagctccttggaaattttatggttaagccatacagtaatgacttagcttcattacataaccacttcatttgtggttagttgctcaattctggtgccatgatcttcagacttcacaaatagatttgtgcaaagcattgtgtaagcatggcatatatagtttaaagaattccttgttgcggaaactccaggttttgttattcgtttgaagggtatgtgtgtttcctcctcctttacttcctccacccccaaatttaggacagggatactagaggcagggaagttttagaaagcacttaaacttttaatgttgtctcaaaacataaacatttaaggcagtcctcttttgaagatggcaaggcaatattttggattataatggtgaagataaaaagacatttttagtaatcttttattgatttgaatattaggatcagagctgatttggtccaatctttctacacgtaagaaaacagtcaaaaatatccatacttggtatatattagaggatttagactattgagtttttggagtaaataaaagattgccttttgctgtgctgtatagtgaaagactagatggaaatctaatatttattaaataagcacgacctccttacccctaagtctgtgagtctatattcctcacatatgaattaggaagttaggttccacaagggcaaatggtgcaaggtcatagccctgataaatggctaaaggattctgtcaggtcctgttcacagcctgtcagctaaacctgataacaataaccactgcaatgtggagggcttacggtgtgcaggtgctaggctaagtgccggtagacatataatatctcactttaaccttactgcagcccctctgtagcaaccatccttgtctccctttttcctgaggaagttgaggcccagagagattatgttactagctcaggggtctcaagcttggagacacagccataactcaggtttgtcagactccagagtgacctcttaacggtcatgcttgctactctggctcttgaacctgaaacaaatggtgaataactgttgaaaatggccatgtgaactagttacctcatacaagtctctttggatgtaacatttcgtacagctggcttaggctcattgtgatttgaattcacccatggttggggctcttcatttccgctctgaaggcttcctcttcatcacagtgcaagagggcaagcctttgcatagctcctttcttggcatctgggctctgaaagctgacagtgctctaactgcgccacagggaggaggagggacagagagagccaaaggcagcaaaggggcaagcatcctgggacttaccataaagaaatgaaacagattttcttcgtggctgacagatgagttctcaagatgacttttgaaggataacactccttttaatttgaaaaaaatgtgataactgtgtgtggaaaaatcagttttgtaacttttaaatctcatcctacattctgtctatagctgataagggcaaagtccaatgtgtgaactcttgctgtagtctactcttattgtgtaatattaatacttgtgattgaattgagaggacttgctttaggaatctagtaatacagtcagcactgtatgtatttgagtttgtctcccgtatgttccggaattctggagttttgacattgtgaagcaacaatttaattttattgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggtatttttcatagtccctgcagtgagttccaagtgcacactaatgcttctgcctaacacaggcagcttatggcatgcaaaaggaggctgcaaagtaaccactgttggtgtgtccagggttagaaaaatttccacagggatttctgtgaaatccaattaaggcagccctttctttttaatagatgattatggagaaaagagactgacgaaacaaaatcagcaaggggaagttaaaaaatttcctgaattgttcagtttcttgtggaaactctagttcctgaatctgagtcttttgctgagatagtgtacagaaagtttgttttgctgctcttcccacttccctcagaatacattatttctgagggaagaactcaccacttttgtctctagccagctttcagttaggcacctggccctaaacttagtcttaaagatgcagtcaaggcctggcaaagttcctttgtctgaaatgggcagtcaagccacttggaggactctacactgggtaggccacttttcaccccaaagctggcttctccaagaaagtcattgctttcaggactgttaggaagttatttgatatattgcctaacatgcctcctattaatgttttttacccccttgtgtctgttccaaacaaatttagttcttctagttgacaggtctccacatacttgagaatggtaatcatgtcctcctggagacgtctcttatctaggctaaacagccttccttcctggagaagtgtttcatggttttgaggcctctctcccttttctaagtgtcctcttctaaagtgtgttactcagaaataagttttgaatttagtctaataaacatggaacaggctaatcctgtgacaaacactatacttttggtaaatgtagtcaaatagtgtgtaagttattttttcccacagacccagcacactgcgaattcatagagaatttactttcggttaaaaatttccaccctttaaaaaggaattattctcttccttgccctccctaattaaagtgaaaaaacttacattttgttttgtaaaattgaacagctatgtagagattgttttgggatctgtttctgtcacagccccatgttacctccagctttaatgtttgtcttgtgtgttttcatacaggtaattaggaaaaacagggatgtgcctctcaaaactttacaaactggccttagtctgtcatcctttgagtattttgtaaaaaataatcttattattcagtttaattgtgcttctctttagctaatattcactttttccacagtgataacatatagtcttgccacaagtcttctgtcatccctttgtgtctacagcattaccttgacttgccagtttagtaaaacaatccaaaaggaaataactggtatcacaaggcttagtgaacctattctgagctctagtaatcactgctgtcattttctcagtgtttaaaaatcatgtcattgttcttgcagtagcttttgtcaagttttacgttatggctttactgacactcatgtgttacagtctcattttatcattatatgctgttcttcccatttgtgtttcctttcgctcctaaacccaagcttcttagagaactctgtatttacccacaccaatttctgtgtctcctttatatgagaatcatgaaatcattttgtcacatataatctgttacatataatgcacattcttttatatattatatattacatatattctctctatataaaacatgtatctctatatctgttatattcttttttgttgttgttttgagacagagtttcaccctcttacccagggtggagtgcaggtgcaatcacggctcactgcagctgcgaactcctgggctcaggtgatcttcccatctcagcctgccaagtagctgggactacagatgcacaccaccacatgtggctaatttttatattttgtagagacggggtctggctattttgcccaggctggtcccgaactcctggaatcaagtgatccacccaccttggcctcccaaagtactagaattacaggtgtgagccaccgtgcccggccctatgttatatttttgagaacttcctagctgtgaagtcattcttaagttcttcctaaataaaaaaaaaagttctacctaaaagggggaaattaaaaattccgtcttctaaacaaagtgttctaaacttgattgtttgcagcttattttgaaagtaatcaaagatccttctgtaccttttagtcttcatctctaaatctacaaagaggaacacatgcctcatatgactatatgtgtgttataaatagaaaatgatattctaatgttcttttaacttttcaggacactgtatgctctttgattcaggacaattagtgtatttttccagaaatagctattcacatgtaaagtgtcactaaagtagattatagagttttatggcaggaacagtggtagagggaagggaggagacaatatttattaagagtatcttatgtgctaggtttggtgttggaaagtaatctaagtagttagtaatgggagttggctggaatgatcatttgagggatgattcaaaggtggtttttggttgtaattatggtgctatttatatatatttttttcttttaaaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtgtgacatgtgcttttctcttctgttgtctggactcttgacacagggctgatttgagcatggccaaggacttggtctctccgtgccagcaaaaaatttcaccccatgccttgcgtggtctacttggtccccgtcagttgcctgatatactggtgcctttcatcccaaggggaaataaggcagatgctagaagagtctggaaaaccctgtgccattctagaaaattctattcagcttacttagattactaactacttagatttttgattactcctctgtgtgattcctcaggcactgtgaccagtaaaaatatgaaatgagtgagcagtatcctctcagctgcatcctcttgattgcatgaaggatgcacttgagcatcctccccatcatcttttagctggttaatggcattgttctgtaaatgactatctgttagggcaagccagagtgaaatctgttgttggttccagtagtattttgttgttgtgtgtgttagaccaagtattacatgactttgaaacacaactttattaaacagaaaaaaatgtgttttaaaatacagtttcttatgtatattgtcacggataatttatggcctgttttgactttttcccttgggatttttatatttagccctgtttgaatcactgtttatgcttccagaaatattagtttataattttacttaaattgtctaccctaatggtcttttagctgttgacatgtggtggcacatctctttactaaattggcctcctgtaaatggaccgctcattctgtggggtgagaaaagagataaggggctagctattaagttaatactctgtctttattctgctgataaacttgtaaaaccgtaggtttttaaattatgtggaaaactgagggggtcagtatttcctggtacattcttgtattttctcttgattaggacacccaaattaaacctaatcctcttagaaggctgggtattgaagaaggattttagagtttaggtatgcctttatggctaggattcttaaattggggtccatagggctttagtgggtccttgggtgggctttggaacactaaaccctgaaattataggtaaaatcttgaaaatatacattttttctggggagatacttcatagatgtcattggataattaaaaggatttgtggtccccccaaccccacccccccaaaaaaagttttagaaactcactattctttgggaaacatcattctttgggattaacactaggaagctaacatgtatgtgtttcctaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcggtaaggtgactgcatggctagaattggtttgagcatggcttctggttgccagagagtatcttccttgtaatgcagtgttaatatagatcagatagaagtttaatctcaagtgctgtttggtaacttgagtatatctggtgcttttggtgtcattgtggctagttggtttcatttttcttttagttattgggccagttcaattgtcttactcatcaactggagtgtacccaaaacaaagatctagccaatcaagtctctgtgtgcctggagaggtaatgaccctttttgcgtattttaacttttgactcttgaactttggtatactaaaagaaagtcgattttgtaactcattgcttgtgttatatttaacttctgtgttgctaggataagatcattctgcttcatgtatttaatattatacttgctgatacatgaataagccatctatctttggttgagtttcttagagaagtgtaatcatttaaaattactcacaatttggcttttgttttagatgaagttgatgaaacagatattccttaaaaatagccaattttgtttttttttccccagactgggcagtttgacccttaagcctgaagattcaactgtcctgctctttgaagctgacacaattactctgcgccagaccatcaccacatttgggtctctcaaaaccattgtgagtaatctcatatgcttcactgggcacttctcatatctgtggcctcacagctggtcttaaaaaaaattgctatgaatagtgactttcttgagaatttgattagcttcaaaaatttcatgttctcagctgggcgtggtggctcacgcctgtaatcctagcactttgggaggccgaggagggcggatcacttgaggtcagaagttcaagaccagcctggccaacatggtgaaaacccatctctattaaaaatacaaaaaaattagctgggcgcctataatcccagctacttggaaggctgaggcaggaggatcgcttcaagctgggaggcggaggttgcagtgacctgagatcgtgccactgcattccaacctgggcgacaaacagtgagactccgcctaaaaaaaaaaaaattcatattctgattaagttgcctaggttggtagttcttggaatgtagtacagactcagtgatactctttggaatgcctcatgtatctctctaaatacttttgaaatattttttgtaaaatttatggcttgaatagtttttaataaagaacgaaacgtttgggtcttgttaaaagtggtaatacaaccaattctggtaaagattttttatataatagttatgtggtagagtattctcaaatttgataactactttgtaagtcatggaatttagtgtgaacagtatttctaatgaaatggtaatgctttaacatttttgaaatttggaattataatttcacttttttggcagcatagcataaataacatgattaaattatctctattttgtagcaaattcctgagcacttgatggctcatgctagttcagcaaatattgggcccttcctggagaagagaggctgtatctccatgccagagcaggtaaaatatcattttgtttttggtaattgagtcattacttggcttatacttcctttgggttttatatagcattaaaaaaatgctactatttgtaaaaaggcaccagtggcaatgagttagtttatgaaattgaatgcttcccttgagacctaatgccaaatagaaatttagatgtcttgtcggggctgattaacagaaaaagtaattatcaatcagttcacaggaaattatcattagctgtcttactgatactggttctctgtgagcgatcctctttataatttgtagagatgatttatttctaaaggaatggcaatgtgaataaaggtttctatatgttttagttgagaagagccctagagatcagctgtgtgtctcttgttttataattgtgaaaattgaggctcttggaaggcacatgatttgcccagggtcagtggcaagccaagattagagagtggctcttctctttttctggtgaactttctactgcatttgacattccttgttttgtgattaacagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggtctgttgctgcttttattgtttctacagtagacacagcagtaggtggagttagttactaatcagtagtactatgtgtcattgttaactttttggttgcagtctggaaacatatttattaatagtctcttcatcatagaaagtttagaaaataaggaactctttatcatagaaaattttaaaaataaagaattttatattaaaaaagcccacaaacccataatctcaacacaaagagaaaaacactgtaacaataaaagtgaagtatttatatacttcagttttctatacatacatattttaaaagaaccattctgtaagtcctgtttcggtaggtagattttttttttcaccaggataacattaacatatttctctgtcatttaatttcttctgtaaagtatttagtagtatataattgattggctgtaatttaaattcaagtttttctggatataaaaaaggattccctaaacatccaggagccaattatttgtgtgcattcttgattagttccttaggagtacatttatagaaattgcattcctagattataattctgcttacgctttaagactttggatacatattgccaatttggcttcccaggaagttgccaacagtttatagtctcaccagcagaatattcagggtacctgcttccctgaaacctaagagtaatagtcatttaggttttttgctctgaatttgacacaaaatagcaattttgcttttgttttttcttccattagtaaggaggttgagtattttcttttttcgtttttttttttttttttttttttttttttttttctttctttttgagaccgagtcttgctctgtctcccaggctggagtgtagtagtgggatctcggctcactgcaagctccgtcctgcgggttcatgccattctcctgcctcagcctcctgagtagctgggattacaggcgcttgccaccacaccctgctaattttttgcatattttttattttttagtagatacggggtttcacccgtgttagccaggatggtctctatctgaccttgtgatctgcctgcctcggcctcccaaagtgctgggattacaggcgtgaaccaccgtacccggccaagtattttcatgtttattaggcttctttgatgacttgcctgatcatatcctttgcttattttttgtgctttatttgtaaaggcatattacacccttttctatcagataagagtatctaaatagagaaatcccttgccttttggctttgtgtacttaaatttcaaaacactgggcaagacagtaaatatgcagacagggccgggcgtggtggctcacgcctgtaatcccagtactttgggaggctgaggtgggcggatcacgaggtcaggagatcgagaccatcctggctaacacggtgaaaccccgtctctactaaaaatacaaaaaaaaaaaaaattagctgggcgtggtggtgggcgcctatagtcccagctactcggaaggctgaggcaggagaatggcgtgaagctgggaggcagagcttgcagtgagctgagattgtgccaccgcactccagcctgggcgacagagtgagactgtctcaaaaaaagaaaaagtgcagacagaatctccaaagcagtcataattgttctggcaaactaatactgtgtactttttgtgtagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggtgagcataaacatcaaaatagcactggtttgagttttatttatttattcatttattttgagatggggtctctgtcactcaggctggagtgcagtggtgcgatctcagctcattgcaacctccccttccgaggctccagccatccccctgcccgcactacagcctcctgagtagctgggaccataggtgtgcaccaccatgcctggctaattttttgtatttttggtagagatggggttttggcctgggctggtctctgaactcctgagcttaagcgatctgcccgtcttggtctcctaaactgctgggattacaggcgtgatccaccacacccagcctagagtttcatatttcataatcccaaaccttgcaaaccggccagccagatccttaaatatgttaaatactaaatttggaatggaggatttatgatttttttgtgcattttccaggcctaagccccatccttcaggaaagaaaagaatctagcctgttttattgctatttatggaaaatatttggggtagaaataacaattgtcacctttgtttttggttgttacagagaatggccaacatttaaattattctctgtagaccctatttggaagataagttggtctcatgcctccttgttttcatgaagcaacctactcttttcttttattgcaggaagtattacttaattcacctctacaggaggaacataacttccccccagaccattatggcctccctgcagtttgtgatctctttgcctgtatgcagcttaaagttgataaagagaagtggttatatcgaactcctctacaggtgggtacatgccaccagcatgaaaattagattatagctatttataaaataaatgttttgtcttacatatgaagtcatacttggctcactgaaccatatcccttttaatagtatgtatattaggcaagtgagggtgggacgggggagctcataaaaagttgatgtattttaattgaatttgctttattaactaactaggcatacttcaaaatgaactttcaagatgtaaccgttgggaattttcagatcccatgtggattctagtagtttatatacctacctcgaaggtgggtttggttccaggccactgcaataaagcaaatatcccaataaagagagctacacaaatactttggtttcccattgcatataaaagttgtatataatacactatagttaagtctgcaataacattatgtcttaagaagaaaccaatgtacatacctcaattaaaaagtattttattactacaaaatgctgatggtcatctgagccattaacacataatcgttttgctgttggaggttcttgccttgatgttgattactgctgactgattaggatggtagctgcttgaaggttgggatggctctgtcagtttctttaaataagataatgaagtttgctgcatcgattgacttttcctttcacgaaatatttctaacatgtgatgctgtgtgatagcattttatccacagtagaactttcaaaattggagtcaaaccatgttgctgctttatccactaagtttatttaatattctaaatcctttgttgtcacttcaacaatacacagcatcttctccaggagtagattctatctcaagaaatcactttctttgctcatccgtaagaagcaactgctcatccgtttaagtttgatcatgagattgcagcaattcagtcacatattcaggctccacttctaattctacttctcttgctgtttccaccacatctgcagttacttcctccactgaagtcctgagttcctccaagccatccatgagggtgggaatccgtttcttccaaactcctgttaatgttgatattttgacttcctctcatgaatcatgaatgatcttagtggcacccagaatggtgaatcctttccaggttttcagtttactttgcccagatctatcagaggaacctaggtagctagggccttaaaaaatgtatttcttaaataatacttgaaagttgaaattactctttgatccataggctgcagaatggatgttttattagcaaacatgaaaacattaatctccttctgcatctccatcagagcttttgggtgaccaagtgcactgtcaatgggtgtagtattttgaaaggaatgtttttttctgagcagtagttctcaacagagggcttaaaatattcagtaaaccatgctgtgaacaggtgcgctgtcatccaagctttgttgttccatttctagagcacaggcagagtagatttagcataattctcaagggctctaggattgaagcactggcttcaacttagccaccagtggccaggtgcagtggctcaggcctgcaattccagcactttgggaggcagaggtaggaagattgcttgagccaaggagtttaacaccagcctgggcaacatacagagaccctgtctgtacaaaaattaacaaattagctgggtatggtggagcgtgctatagtcccagctactcaggaggctgaggtgggagaatcttgtgtctgggaggtcaaggctgcagtgtgctataatagctctgctgcggtcttgcctggttgacagagggagaccctgtctcaaaaaaaaaaaaaaaaaaaaaaaaaagagtcactggctgtgttagtccctaacaagagagtccatctgtcctttgaagccaggcattcacttatctctctagctatcagttctagatgactacttcttccaataggaagttgttttgtctgcactgaaaatgttgagtgtagccaacttcatttacgatcttggctagatattctggataacttgctacttcaccttgcatttttgctatggagatggcttctttccttaaacctcatgaaccaaccactgctagcttcaaacatgacttctggttcctgacctctctcagccttcataaaattgaagagaattagggccttactctggggttacgctttggcctaagggaatgttgtggctagtttgatctcctatagagaccactaaaactttctccatatcagaaataaggctgtttgctttttaaattattcatctgttcactggagtagcacctctagtttttttcaagaacttttcagccagagaatgagaagctgaaaaacaacaaaaaactttgcttttgtgctcacagcttggctggtccaaaaggcctgcccagctttcagcctctcgtggccttcaacatgactttctcgctaagtttaatcatttctggcttttgatttaaagaagagtgagagatggggactattccttttagttgaacacttagatgcaattgtagggttaataattggcctaatttcaatcttgttttgtctcagggaacagggaggcctgaggagagagaagagaaatagggaaaggctgtttggtgggcattcaggacatttattgatgaaaagtttaccatctttaatgggcatagttcatgacacaaatgcttaatttgtaaaaaatacaatgtaacaagggtatacctgtattgggaaatgagtcggagctttaaggcagggaaaatttgcttttattcttcattgaagtaacttatcatctgtgggtgtctctttacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccatagttgttgcgtgttatttttaaaactatttgtcacaaagtgtggtgtggtaccacataacgtggtaacttttggttagtaatccagctgagaaacagcttgaacataaaaataacatcagtgtattttatgaaaaattagcaaacaataggtatattaacctccattttcagtcttttataaaaactattcacatctattaaaaaaaaacctatgggacttcagccaagattcagtgcctttctactggattcctcttactagatgcatccgaagaggccctagtttactttctccaatcatatagccaccaggtatttaatacagtaatatttatgtgtataacctgtagtgcaattatacatgattaacttcatatggtggatgagaaaacaaactcagaaattaaacaatttggcctcatgtcctttagttttcccaaggcttccttgaaaaacatctagctcttggccaggcacggtcgctcacgcctgtaatcccagcactctgggaggctaaggcaggtggatcacctgaggtcaggagttcgagaccaccctgaccaacatagtaaaccccgcctctactaaaaatacaaaaattagctgggcatggtggcaagtgcctgtaatcccagctacttgggagactgaggcagaattacttgaacccgggaggtgttcaagtaatctcagcagtgcgctgagattgtaccaccgcactccagcctggggaacagagaccctgtctcaaaaaaaaaaaaaaaaaaaacctagctcttaattattcctagtaaggtgtgagttaatatgtatggaatgaagcaggattgttggaaagattgttctagcatactagtctaacggctgacctgaaataccttgaggtggtttagtaccagctctattggtgaatgccaccagtagctcatttctttttttgaaatggagtctcactctgtcacctgggctggagtgcagtggcatgatctgggctcactgcaacctccgcctcctgggttcaagcgattctccagcctcaacctcctgagtagctggggttacaggtgcacacccaccacacccagctgatttttgtatttttagtagagacaaggtttcaccatattggccaggctgattttcaaactcctgacctcaggtgatccacctgccttggcctcccaaagtacagggattacaggcgtgagccaccacacccggccaccaagtagctcattttaacacaaacacgaagatgttgttttgcccactgggacaaaaaatgccaagggtacctttcactttatacccaggtagatacttttaaattgagacaaccactatgtttgtgtgttggagttataactttggttctgtttttaccctttatttggaatacagtgcaacattacagttttggatcattaaatgaatggacttggtgatatagtactaacaagcacgacctgaattctgggagtaagtggttttctagttcatgggggaggaaaacagatacgtgcaagatctccagaggagaacagaaccatggtactcagtgagtcaccaaagggctttggcttcaactcactaatggctggaacaagtgccagtcttggtcagccatccaggattttcatcacagcaaatcaaaatctccaatttttcaaactaattgtaggtagaagagagagaataactccaaactgtcttataaaaggatctagatgactactgaagtgtcctccattcatgagttggcaaaatcttcagagtgactgttggagcaaggagcctttcatgtgctcccagttattatatagtgcatagaggctggtaagtgttagtcctgtcagaccacctcgtgctatccctcgaagaccacctgggaaacagagacaaaaggaaaatgaaatagctgtatattgcatagtgccctagcacgatagggttaaataaaaagtactgtgaaatgggctgggcacggtggctcaggtaatcccagcacttcgggaggccgaggtgggtggatcgcttgaggataggagttcaaccagcctggccaacatagtgaaaccctattaaaaattcaaaaaaattggctgggtgtggtgatgtgtgcttatagtcccagctacttggaggctgaggcaggataatcacttgaacccaggaggctgaggttgcagtgagctgagatcataccactgcattccagcctgggcgacaggatgagacaagtgagactccgtcaaaaaaaaaaaaaaaaaaaaaaaatactatgaaatggagagaccattttaaaaataaatcaatattccatctcaaaaaggagacaacgtttttaaagtaataccacttgtgtaatacatatgacttaa

SEQ ID NO: 14461 - DNA, 87870 bp, Human
tttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaagcagtgatgtggtgtgtttattttcttttactcatctaggaacttgacgcagctttatatttaataaaataatagagattgcattattttaaggtactttcatgctttgaagttttgttttttttaaactggcttcctcaaagccatttcctggaggtgtactcatccctcaagaagagtttgttgactatgattaaattccaaggaccagtgggggaagtctggaaacccaggaatctccatcaggaatctggggctctgtccagctccccgaaggaaactgcgggtcagatgttttgatttttttttttctttgagaaacagaatctcactctgtcacccaggctggagtgcagtgaagtgatcttggctcactgtaagctccacttcccgggttcacgccattcggcctcagcctcccgagtagctgggactacaggcgcccatcaccacgcccggctattttttttttttttttttgtattttcagtagagacggggtttcaccgtgttagccaggatggtctcgatctcctgacctcgtgatccgcctgcctcggcctcccaaagtgctgggattacaggcgtgagccaccgcgcccggccgccagatgttttgacttttcattttatttctggttgcagtcaggttgttaagtccagggactcttgccctactccacctcgttctcttattccatttcattcccggggcacacaacttggaagtctttctctgaaagaaggaaaattcattgcagacccttaggaacagcatcttcttagagggaagccaggggctgggcagagacgggaggaggagaggaagagaatatggaaacgagtaaggcacactcttctcaggaaggctccaatttgaaggatagacaaaggttaccataataatggtggggcctgacctcaccccattggatgctgtgccctggcttgcagagcactgggaaggtagcctagtagcataaattgcatttctagtgggcccagaaaaaagcaaaataacggattgattcaagctgatactgagtagcaaaattttgggaagagtcaacggtgcaagtttgtccgaggaggctgccgtgggcgcggctattccacacattacggcgcgaggcgaaagccttagtggaagcgcgtcctgcgcaaagccggggggcccccgactgcgccttggctcagccttcggttccgagtcctttccgtgcggagtctcccaggggtggcggctccgggtgcggacgcggagtccccaggatcagccggtgcgcagactcggttctttacggcccgattgccacgcaggtctcgcgagagcgcaggcgcaagtgtcgcgataaatgggcgccggcggagcggagggagatccgagcggcggcggcaagctggctgcgagcggctgaggtaagcggcccggctcgcgcgggcggcggggtcccggggtcccgggggtcccgggaatggcaagggaggggccgagggcccggaccgggtgtgctcgccagggtggggcacaacgacccagaccccgtgcctcaggaccccgcgcccgccccgtctcccatgggcgcgctctcctctctgtgctctcccctcctctccccactcccctgtccccactccccctttgggctgtgctggggacagcgggcccctcgcctgggtctccgcagccgtcccttgtgccagggcgggcggccgaggggcgcgtgctcgtggtcccagccccggggtcccgctgcctaccgtgtgggtccccgggctagggtgccggcgcgccgaggaaggggcctgagctggcgcctggtggagaagtcggggctgcaggggctcttggcatcctggtggctcgcgccggtccgctctcaggaagggggcgtgtgggcccggtttcccctcggggatggcaagggccaccctgatctcgtttgggcaatggaggaattgggctgtggagcctccttccaggcgggcctgcctctgcggggctggcagcctggggagctcaggcctctgcttgcaccaggccaaggttcttgttaaatggaaactcagaaactgtgcagctgcagaagttctacctttggcttttaaacgcgcttggctgttccctagttgtggctggtgggccggcctgccatgagcccatagtaagcgccggtgttgggggtgcaaagttctttactgcggtttgtcttcagccttccaaagccagacagacccaagttccaatctccgttctgtaactttttgaagcttcggtttcatcatctctagaatctgtgtaaaaagacctaattcaccaccctgttgagactgagcttacaaatatagtgctggtcaacctgcagccgtattcccatcatctagcggtggaagacttgagggatattggccccgttccccacaactttgcaagtagatttcactgtcatgagtttacagatgaggaaactgaagttcaagaagtctcggtgctcggaaatgtcagatacctttctttctgatacctagttgaaaatagtagtagtacttattaatgtcactagaaataaacaatgaaaatgagcacagctgtgatgatcatcatctttactgtcactgttgcatgcctcgtttctgattcccagaggccagattttttttttaattaattattattattttttgaaacggagtcttgctctggcacccaggctggaatgcagtggcgcgatctcagttcactgcaacctccatctcctgggttcaagaaaatctcctgtcccagcctccggagtagctgggattacaggtgcacgccaccacatctggctttagtagagatggggtttcaccatgttggccaggctggtctcgaactcctgacctgtggtgatctgcccatcttggcctcacaaagtgctgggattacaggcatgagcaacagtgcctggcttatgtttatttatttatttattcattcatttatttattttgagacactgtctcaccccgttacccaggctggagtgcagtggtgcggtctcaggtcactgcaacctctgcctcccagtttcaagcgattcttgtgccacagcctcctgagtagctgggattacaggcgcacaccaccacacccggctagtttttgtattttattagaggtggggttttgccatgttggccattctggtcttgaactccggacctgcctccgcctcccgaagtgctgggattagaggcgtgaaccaccctgcctgggcaagaggccagactttgctgtgagtgctcctggtaggtagtttcaggcatcaactgactggattcaggaattcctagaaacctgggaaagcatcatttttggttttgggtgtgcctgttgagggtgtttccagaggagatgagcttgggagtctgagtggaccaggtgctgaagatccatcctcagagtcaggggcagtatctaagagcctgggggcctggagaggacaaaaacagagaaaaggcgaatgtgtccatctgcctgcaggagctgggatacactcttcctctcctctcctcaacagcagcactccaagctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgtgagtcagtttccccaataaagcccttctcttgtgtctgtctctgtgtcctgttggctctgtgtctctggagaaccctcttacagtgcagttgggggacgtgccacctgagtgctgagccccgcctcccgggcgccagctgtccatctgtccatgtgcaactgagactcaattggtggcttgctggtggggatttggtggcatgcttccttgcttccattttttgtctggtaaattggcagcatggctcccagttgccattgaagaatgtggttacaggcatgggtgtattatgagctccaatgtgcgttaggggagtggggctgtccagaggctctgctgactgcacggctgatggcacgtggaaaggctgcccctgaccagtcctttgtctgtccccggaaggaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcaggtgagtggcatgtgcctgggtgggagtctgctctggggagaccctgggcccgggcaggacctcttccagtcttctgtagttgaggtgggtcggtattagcagagcctagagacagctattcgtctcccaggtctcactatgggcactcctcattttggggtcgtagctggaggctagttggggccctgagccatcctggcttaaaggcctgccttgttagcgccctgagtgggcctggcgctcagcattgcgttcacacaagtgcactcacagaccctggtgacaggatcggaaagccagttcattcatctaattgaggacagaacccaaactgcctgggggagtgagcaccaggactgtcgggaaggctgtgttggaaacacagtgctgagagtgcctgggcagcccagagacaaagccacagcagtgagcagaaggactgggtgttttgtggtctcagactgtggagggccatttacagattttggggtgatttttacagttttcttctataaaatagttgtattttgtttcattacaagttcttggggtttctcactgtagacacaactgcagaggattcaggcctcctgaaggacttcaggctccaaagagtgatgagcccagtcccagttggggctgcgataacggggcccccaagttgtagggagtggtggggagtggagtgctggctagtagtgtctccagccttgcctgggccctgtggctgcgcaggctcctctaggctcctctgcctggaccctctttcccagtccctgctgcggtccccagagccgttctgtagttctgtccgcattagaggaggctctggcttcctgcgctctcagagcccagatgaggccctgctgcatttggttaaactgtgtgtgcgtgtgcatttgttttgttgcataattgaattaatgtgtgtttattagaatgctagcttgtggccagatgtggtggctcaggcctgtaatcccagcactttgggaggctgaggtgggcggatcatgaggtcaggagatcaagatcatcctggctaacacggtgaaaccctgtctctactaaaaatacaaaaaattagctgggcgtggcacctgtagtcccagctactcgggaggctggagcaggagaatggtgtgaacccgggagtcagagcttgcagtgagctgagattgcgccaccgcactccagcctgggtgacagagtgagaccctgtctcaaaaaaaaaaaaagaatgctagttgctagcttgctcactgccctttcttgatgaggactgttttttattctgagattaggtcatatatatatatatgtgtgtgtgtatatatataatatttatgtaaatgttcttttgtgaaattatgaaggtaatagatggtagttgttttttatcactgacaaaatgagaagtggccaactctgagctggttgcagtggctcatgcctataaccccagcactttgggaggctgaggtggctggatcacttgaggtcaggaatttgagaccagcctgaccaacatggtaagacctcatctctactaaaaatacaaaaattaggcgggtgtgggcacctgtaatcccacctactcgggaggctgaggcaggagaatcgcttgaacctgggaggcggaggttgcagtgagccatcgcgccactgcactccagcccgggtgacagagttggcaactctggtctgaaatgctgtgattttagtgttgcgaatgtctgggacctcttggcctgtctgtcaaagctgtgggattctagagtctgtcttggggctcggaggcccccagtgctcactggtaaaggcctctcggtgaggggatcagtgatggagtgcggtagtcagagcaaggtggtgagcggagtgatggcggcaagaccagccttggtccctggcccctgtcacatcccattcctggacttcgtcgtggttctctctctcctgctgagcccccggcgtggcagggagggcctggagaacatggcaggccgggggaatgtgtgctgtctggtttctcacacatcgtgttgatttaacgtaagggtaaactttcagggttcctttctttccgttgtagtcagctccaggcagaggtggcacacggatcaggtgtgtctgggactcctggtccctgccggtcgtgccccctgcaggcggggtgcccacccttctcgagaggctcaggcttgactgcagacacagaagtgagaccaggaaggctgctgagtttgaagggcagtcttaggaacgcccaaacagcagcagctgagaatcgagacacagtaacataggagtaaaggaagtgtgggcttgggccaccagagaacacaggtgggaggacagagaaacttccctcccctgtcccaggctttcctggccttggcacgcttggcatttgggctgggtaattcttttttctcaggactttcttgtgcattgtgggctgtttaacaacttccctggcctctaccccctggacgccagccagcagcagacacatgtgaccacccccctgtgacaatcaggtgtctccagacagggccagatgttcccaggggcaaaactggaccccactgggaaccaccactctactctggtgcttctcaacctttcatgtgcatgtgaacgccctgagaatgtgtctaaaaagaagtttctttttttcttttggagatagggtcttactctgtcatccaggctggagtgcagtggtacaatgttggctcactgcagcctccgtctcctgggttcaagtgattctccctcctcagcctcccgagtagctgagattacaggtgcgttaccaccacactcggctaattttcatagttttgagtagagacagggtttcaccatgttggccaggctggtctcaaactcctgacctcaagttatgtacccaccttggccccccgaactgctgggattacagacgtgagccaccacgcctggcctagattcttttgtttttttttttttgagacgaactcttgccctgtcatccaggctggaatgcagtggtgtgatcttggctcactgcaaccttcgcctcctgggttcaagcgattctcctgcctcagcctgagtagctggggttacaggtgcgtaccaccacgaccagctaatttttgtatttttagtagagacggggtttccccatgttggccaggctggtcttgaactcctggcctcaagtgatccacccgccttggcctctcaaagtactgggattacaggtgtgagccaccacacccaacctaaagagaagattctgactgagtaggtctggggtgtagtctgcgactctgcatttgttaagtgccgggagatgctgcactgcaaggctctgggccacgtgaagagtcagtgactctgccttttcctccagctgagcaggtcgtacccaaaggccggctctggaactatttggcaagtcttctggggctctttgaggctcagctaacctgtaatcactagccctgtgtggtaggcagacttctgagagggcccccaggagctcagctcacctgtaatcactagtcctgtgtggcaggcagacttctgagagggcccccagaggctcagctcacctgtaatcactaaccctgtgtggtaggcaggcttctgagagggcccccagattccaggctccttgtgcacactcaccttcctactgcctcccaggtttcagtccaatactgagtaggtttcattgctgtgggattgtgcagatgtaattaaggtctaagatctgttgaccttgagatagggagattacgtgggtgggcttgatccactccctggtgggcttgatgtactcacctgagccctttaagtctgagtccagacgtccgaggccgagcagtcaagagacatagcaggagagggatttgatgagggagattggacgtggttgactttggagatggagagggccgtgtggcaagggatgtgggcagcacctaggagttgatggctgtactgggctggcagccagtcgggaaggagacctcattctccatctctgagctccacgtgagaacatgtcctggccgactgcattgatttttagtctgggagaccctggtcagagaatgcagccacctacgtctggacttccgacccacggagccgttggctggtaaataaatgggtggcattcgaggccgttgccttcactaatatgcttaatgtcatctcaaaagacgtcttcctcttcccaggctttttcaccttcccgtttcctgcccctcccctgttccccagcctggagcccagtggctgggccacatcaagacttagcacgggacctgcgggaatgggtcctcagggagtgtgtctgctgcactgagtcactcacctggtttgatgccgtcactgaggattctgtttttctttgggtgcgacctgctcagctggaggaaagagcagagcagatccgttcgaagtcccacctcatccaggtggagcgggagaaaatgcagatggagctgagtcacaagagggctcgagtggagctggagagagcagccagcaccagtgccaggaactacgaggtgggttcaggcggggcgagggtcggcccagacagccccaggaagcaagggggctgtgcacggtacctgccaggttataagaaatcacatcctagtccctgggagcaagggggctgtgcatggtacctgccaggtcttaagaaatcagatcccagtccctgggagcaagggggctgtgcacggtacctgccaggccgtaggaaatgagaacccagctggctggaagcctgacacgccctgtgtcatggttgccaggacattccttctgaggccactcatgctgtggggcaggtatcagttatgcttgatgtcctagaggagggtggcatgaaatgggaacacttgctgtgtctgttcattgaggctgcggtgctggcacagattcttttgctgggtctcctggtttcctcttccctctggaagaattggaatgcaggtctggcagaaatgccaagtggtgtaggagtgacaggcttaggaggtcatggggtggatcagggtctcgggtccatgctgggtcttggggttggagggccctagcaaagggtgccggtctcaatggcggctctgtgttgctcctggctccccagggcagcagggaaaacaccctgtccttggggagggaattaggtttccactgagtgcgcggatcccctctgctctgattaacagcactttgccagggtttcagtcagtgctgatcagttgtggaaatgctgccaaggttcaggcagagtattgggcggaaagtctccctggcctccgtgccctctcttggcgggtggatgtccagccccgccctgacatcatgcggtgtattcacacactctcctgggccctagaaaaatagctcacgtcttccggggtgtgatgctggttggattgcttgcccctggcctgcagatcctgactgcggtgtgcgttgtgtgggctcagtgagactgaggcaccgctggggtgggggccactgcctcagggttggctccgttgctgctttgagagctgttttccctgagaggtggggcgtttgctcatggcctgggtgggtcctaggagggacagtactggaggaattggtgggaaggggagggagagtccacaggagtctccctaactactgagattcccttgttaggggtggagaggagccaccaggtcattggtctggaggcagcatgctgatggtatggctgtggctgtcaggcaggagggacagtgtgcagctgttggagttcctctaggccgagagtccctgagggcagggcccacccgactctgcccaggatctccattgtgtggcacagcttatggcattttatgggtgctcacaaatgttggattgagggaggggtcattgtagggtctccgggaaccctgtcttggggaaatccaaggatgcaggtgactgggcttacacctggggctccctgctgagctccagccaccttctaacaggactgtccttccttgcccgcagacacagctgcatgggaccccaggaacagtcagaaccagtagttttccaattgttccttggagttccacctggaaatacctattaggggcgagacttaagtgtctgaagtccaaagacctgctggctgccctgtctgcgctgggactggcagttccaggcccggtgccgcatctggctgtgatggtgctgagcggagccccgtgccaaccccagttcttgtcctgcatcacagaagggtctcttggttgttgtgaggcagcccttgcagctcacaagggctggagtccctccgaggtgcgcgggtcagcctctctcagaaggcggccacctctgtcacagctctcctgggttttgggctggagtaccctggatgaggacagcacaagctcgtactccacccggggctccgggagtgcttggtgcttcccgaggaaggcagggtgagagggtcccggagtgccgggctccaccaggactcaccgccttcacctcctgggacgccggtacctggcagtgaactctggagggcctgcgggtcattagagtcaggaggtctgagcgtggtgcttggtcatgtcccatcccaaccagtgagagccacgcggcctccctaaggccagtcgtggggggtgggtctggaggtttgtggtttgtgtgagagggggtgcatgtgtggcagatttgagcccagtgtaaactgcttctgcccacagcctcctgtccacgctgcctgtctctgcccctgttgtctgctcgctgggggagtgccagctcctttcagtgccggacagagcgtaattagacaggatttgctggtgctatgaaagctcagcttctccccaaggtcaatgctgaattttagatttcccatgccccctctccctgcagaggcaactgctgagcagacggtgtgataaatgtgtgtgtgatctgtgccaagtgcccttcctgggagccctgacctcgcacagtgctcaccgtcatggtgccacagcgggggtgccaacgctggggctgggtcccaggtcccgtcctggttctgcctatgacttggctcatgggtcctgctcggctcttttttgtgcctcggcatgttctgagagaggtgtgggggtgagggctccccgctgaccctcccgtgggcggcacgtggcatctgactcttgctctcttaacagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgaggtgagcggggcctctgctgcgcagggagctgttttcccgaggagagggagtgcatgctcttgtttgccactgcagtgcccgcttgtgttttcacttgtgcttcccacacgggcagctgcgttttgtacatagttgtcatcagtagaagtattaattttccattctgtagttttcagttaaaaagttgagactttgggccgggcgcggtggctcacgcctgtaatcccagcactttgggaggccgaggtgggtgtatcatctgaggttgggagttggagaccagcctgaccaacatggtgaaaccccatctctactaaaaatacaaaaattagccatgcgtggtggtgcgcacctgtagtcccagcctgtgggactcgggaggctgaggcaggagaatcgcttgaacccaggaggtggaggttgcagtgagctcagatcacaccattgcactccagcctgggcaacacagcaagactctgtctcaaaaaaaaaaaaaaaagttaagcacttttttgcctttgtaattatgaatttaaatggatgatgaatctgttttttgttgtttgtggacgtttagtgtgtttgtgttcgctcatgtatgtatgcgacaggtagcccttccctcagccctcgcttctgttgactttggacagacccctaggactgggttataaggtccctagcgatggcggtctctgcagccgttgtgctcagaggcctggctgagggctccaatttccccgtagccttccctgtcgtggatggtggtcttttctggaaatagctgttgttttgtcaggaggcttaaggaggcacgtctggatttgcatatctttgactgtctgcaaggtctacaggcatctgatggcgtcggataattgcctctgaactggagcctgtgtgaactgcagtcctggtgaaggttgcttgcattttagaaacagcccagacatgggcactggtggaaattggaatcttctgacctctcctgtcctttgtctgtggcgatcaagatcgctggtgccaagaggaaacatgaaaatctgctggtgtgggggtggaggcgtggtaggggtggggtgggcgtgcagcgggggtcctggaggggtccagaaactggccgcgggtccttcctgtggccgtgctggggaggcgtgttcaggctgttcccctatctgcttctggagggaacgttggcaggagaggaggcgtgattggctcccgagaagctgctcttgccttgcccatgctctgggttccagttcccatgtgctgggctgtgctggagttgggccgggggctgtccccgctgcctgcgggcacctgtggttccatgggggagggtgagtcgtgccgagcacttcatgaggggcagaggagcaggagactgcaggagccgcagggcggtgcccggtggggtggggcatagtgaggggaagatggtggcgctgcaggtgctgctgctttggcctgtcatgtctaagccgaggtggcagctcctcagggaagccctccctgcgcactaggccttgactgccttctcctgtcacagggtcctgattgtcacgctccttactctggaattatcttatgcgcctcttccttgccaactgtccggcgtcccctacaacacgggtgaccctgtgggcaggtgggctcggccctgcatctggccttgcccctggcacacggtgcgtattaattgagttcggaagacctctgggaggatgtgtttattgttagtatgtttttaatacctttcttctttgttgactcccaggttgatgcttcactgttgtggtgaagtaaaccgtacatattgtgggcatgtggggagcacgcagcccccatgcgggccttcccagagcggcgtggggtggacagcggtgataggcttcagcaggccctaagctgggcacgttctcagggacagggaaatgagtgctgaggcctccttgtttgcggagggtgccgcccagccaggcccacccaggtcgtttgctgtgtgagtttgccattgtcctgtcctgggtgcgtggtccccagggctgacatcacgcccgtgtgtttccgtgtgttaacttacagtgatgcttctcagggtctgtccggcttttcacattggctcgacccacgtgctctttctttctctgaggacacctggggttttctgagcttttccagagggttagggtcctcagaaggtcgcctggtgggagtggtcaggaggaagcctggcggttctgtcgcgtgcgggttccatgatgtcaggcagacctgctgtcctggaggctgccagaggggctgctggctttgctcaggggccgcctccccaggggcgctcctgcccgtgccgcgtgctcccgttccaagcgcacggcctccccagcaggtaccgccctgccccttgcacagcctccgtctttgtcctgttggttggccagtgccttgctgtggtgtgagggcgatgtcgctagcaaacagccgtcatggtagcattggggtggctagggagggatgacaggagccacggttggagggaagaccgaagtgatggtgtggcgggtatgtggatgtctgatgggactttgggagcgtggggcactggcacagagactgccaggtgccaggcctgagagtccgggcccatcttggctggtggaggcttttgcttctgaagccgcctcaccaagcctcctttccagggcccctggctggggcccggtctcctctgtcagctcctgggtggcttgtggcaggctctgggctgtgctgctctggagcaccaggaggagggtgggccctgcgtgtgagcgtctgcctgacctgcatcctccagaaggaggtggctctgccccctggccctctgctcccctgctcctcttccccctgccctctgccccccttgcccccttgccatctgcccccctaccgctctgcccccctacccctctgcccgatgcccctctgcccccttattcctctgcccctctgcctcctgccctgattatagcacgtgggtggtgtcgcctctccactcttctcatctccatgtgcaggctccttccacgcacgggctccactcactgagcggctctctggtcccctctacttttagaccatcaacgcactgaaggggaggatctcggaactgcagtggagcgtgatggaccaggagatgcgggtgaagcgcctggagtcggagaagcaggagctgcaggagcagctggacctgcaacacaagtgggcggggccagggtgtggggtcgggggtcgggtcacgtgtgggggcatgcgtcccacctctctcttggtggctgggtgggatgtggatacactcccagatgctgtcctaattcacagacactcaagaggggcagatgctgaggcctctggagccaggaccgtgagcccagaaagtgtcctgatgttcctggagcagaatgggggcagcaacttcctccccctccttcttagagagggctcctgcagagccagattttactttattttttgagacagggtctcactctgtcgtccagcctggagtgcaatggtgtaatcatggctcactgtagcctcaacctcctgggctcaagtgatcctcctgccttagcctcccgagtaactgggtctgcaagcatgtgcagtacacctggctaatttttttttttttgagattgagtctcgctgtgtcacccaggctggagtgcagtggcaccatctcggctcactgcagcctccgcctcctgggttcagtgattctcctgcctcagcctcctgagtagctgggattagttttgcacctggctaattttaaaaaacgttttgtagagatggcggtctcgctttgtaacccaggctggtcttgagctcctggcctcaagcgatcctcctgcctcagcctcctagagtgctgggatcccaggctgagccgccgtaccctgctgagggctaggttgaaagggcagcatcatgtgccttggaggtggagggggcgtggctgggaagggatgtccaggcacagggctgagccgaggcacagacgtgagagccttgtctggaggtgcagtcaggagactgtgggcatctcctgcagacttggacccttccatcagcagatgtggttttaggagagttctagttccgtagtagagaggagaggtcattcctgggtggggccctaccgcagctgcaccagggctgggggttgccgcaggcaggtgagagctgtgggttccactgttggagaggtccttgcaggtggcctgggctcactacgcaccccgtctgaatgagcagactgaggcctgagagccagcccacaggggctggggcctgggaccttggggtacccatgcagtggagtgtgtgttggcggggggcggggggtctgtgccgtgggaggtcctgaaccttggggtgggaatgaacgtatgtgggtctgtgctggggcgggtctcaggctgaggagaattgttggccttgccgcatgcctgtttctgtgtgtgatgtatttttctttcaatagaaaatgccaggaagccaatcagaaaatccaggaactccaggccagccaagaagcaagagcagaccacgagcagcagattaaggtgagtcactccctgtcagtgccttgtggacatccctgtggtggccttgactctcctgcccctgtcggcctttctgcgctggtgccgagctccgtggtccttctgtgaggttagctgctgccctgtgtgttgggcactgtgctgggcaccagggatgccatggtgaatgaggcagatgcttccgctcttgggagcgtgtattctagaggagggagactgaccacaaacaccaagagaaaatgtccgtgtgtgtgatgacgtcaagtgctgatgagcgtgagaagatgctacaggcatagagaggttgagaaagctgcccacagttgcacagctggagctgggtctcagtcagggcatctgactcaagctcaggctgtgccatttccctgcggaggacgtgccagggagacgttgactccagatccctctcctgcctcctgttgcctggagagcagcctccagaccctgtgctctggccgtgccctctcagcccttatgcaccctcacctccaggcttcacaccagctcttcctggctgcagagctgcccggcacccccagcctggcctctgccatgtccgctcctggtggtggtccctggcccctcgcagccctcagtccacctctcaggattttctggctggcagggcgatggactctgttagtgtttgttgaatgaccgtctggtttggtcgtggtttcatactctgcctgttcagtgacttgctgctcacagatgccagctgtctgtgtcccaaggggactgggtaccgtagggaaaagcctgtcctcactattggaaagactgagctgtcacacgtgctgctagagtggcagaagtgggcttgacacgggaggggtgggatgttttaccatggagtgccatcctggaccagacttgagacagacttttgctcctggagagctccccgagggcaggtggtgagcacagcagcccggcagtgtgcagtgtgaatgccagctcccagtacgcggagggctgggaggtcggcgctgggaagagctgccctggagtggatgctgaggctcagtattggaagcagcttcgaggcccctggtgcagcccaggaaggcctcccacaggagagtcctgaggcatggaggctgctgaggacctggggcagtttagcgaaggaactttgtgacctcaatgactttaatttttaatggatggtattttctagagcaattttaggttcacagcaaaatgagcagaaggtaaagctcctgtgtaccccctgcgcccgctcctacacacacagcctaccctggtagagtggagcacgtgtgacggtgatgaacctgcctggacacatcagtgtcacgcagagtccacgggtcatgcgagggtcactcttggagtgggacagtgtatggttcgggcagatgtaaaatgttctatatttgccattagagtgtcacacagaaaagttttactgcctaaaaatcctctctgctcccccagtcaatccctgcctctctccttctgagcccttgacaaccccttcctttcccagaacgtcctgtggttggatcctgcagtgtgtatagccgttgcagaccggcttccttctcttagccgtgtgcgtgtgattttctccaggtctcttcgtggctcatttttcccttcttctctgtccctggcctccatcaggatctggagcagaagctgtccctgcaagagcaggatgcagcgattgtgaagaacatgaagtctgagctggtacggctccctaggctggaacgggagctgaagcagctgcgggaggagagcgcgcacctgcggtgaggggttgcgggggatggggcagccgcctcgagtgagtctgggtttgtgcacatggagcccactgtgcagaccctgtaggggcagggctcccgggctcttggccttatccctagggtgtgtggctatttgagcgactctttgtggcactgccagggagatgagagagaccaacgggctgctccaggaagagctggaagggctgcagaggaagctggggcgccaggagaagatgcaggagacgctggttggcttggagctggagaacgaggtgagggcctgtgtggtgtgcggttcctgtgggtgtcctctgccctgcctggaggagcctcggtattgtggtcacgcccaccagctgctcacctacaacatggaggttgctgtgatggggtgggaggcagaatcgtggtccccagagaggtccatgcctcatcctcagagcctgtgaacacagcaccttccctggcagggcgaatgaggtgactggtcagctggcccacggcggggaggggctcctgggccatcctgggggctcagagtgatgtgagagggacttggcagctcttgctgggtgtggagatggaggacgggccacaagccaaggaatgtgggtcatctggaagctggaaagagcagggaagtggactgtcccctggaatctgcagaaggaacacaaccctgccaacaccaggattccagctcggggagacccgttttggatttccgatctaaagtactataaaatattacatttgtgggctttttttttttttttttttgagatggagtctcgccctgtccccaggctggaatgcaatggtgcgatctcggctcactgcaacctccgcctcccgggtacaagcgagtctcctgcctcagcctcctgagtagctgggactacaggcgtgcgccaccacacccggctaatttttgtatttttagtagagatagggtttcaccacgttggctaggatggtcttgatctcttggaactcgtgatccaccctcctcagcctcccaaagtgctgggattatagacgtgagccaccatgcccggccaggctttttaaatgttaaatttttttttgtagagatggggtctccctgtgttgcctaggctggtcctgaactcctgggctcaagtgaccctcccgcctttgcctcccaaagtgctgagatgacaggcgtgagcctctgtgccgcaccaatttgtgttgtttgaagccacttagtttgtggtgatctgtttcggttgcagcaggaaactggtacagagggtgagtcagaatgcgtgtggcactgtgaggatcagggctggcagggccctgtgctgggggtgttctgtcttcaccgcggcagttggtaggaaggtgtcagtgctggaaaacatcctgcagtcatgttgcgggcagaggaggaaactgaggttcagagaagctccctctcttgcccggtgcacagcaagtttggaccagaatttaggccttctggcccctgcctgggtcctctgtccttcatgccacttccctgtggccacagccactcccctctgtgcctggcacacctatgccgcctttctccggtggttgtggggcctggcaggagggcagactccatctgcagtgctctgcagctgcccagctgtccagctggccacttccagagtccccttgggtggcgtggcgtctctgtcctcttcagagctgtgatacagccaaggtcgttttggggccttggccctgtgacccacggtgaggtggctccctgtcagcgggggtatctggcagggactcttctctcaggtgctgggttctgtaggagcttagcctgaaaagacagctcccatgcgacatcttttctctctcccgcggtgtaatttattgtttgatggttgaagagttggggctctcaagccacattccgtagttgggtgcttgctgctccatgtccctgggccagctccttcatctccctgtctgtctccccgtctgcacagggaggagtggtgctggctgccttgtcaggactgtgaggctcacatgagtctatgcaaagtgctcagagcagtgcctggcgcgtagcgaatgttctgtagcgttggctgtcatatagttactagtcaagtgcgtgcctgcgcataggaggggctgtgagaatacctcactgacttgccgagtggagcgttgataacagcatggtgcttggcactgggtggaggtgaagcgaggccagaacaaaggcacagagtccctgccctcagattgcttccgtcctagaagggccgtgagactcacctctttgggatgcggctcagcatgggacaggcatgtgacacagaggggtgggctggcctgtaggcagtgtctcaccctccctcatgctccagggtggctgccctcctctcctagggcctgctggtcctggtctgctgtgtgatggcaggaagtttggctccaggactgagtctgtctgctccagggcttggttccctgaggagcccctggaagatgggggagggatgagtcctaacggctcaaggacccgaggctgctccctggggcacagtcaaccccaggatcctttctgaggctgtctgccttctccctccacagccacacgttgcttttagcttgctgggattcacacttgaatttacggggccaggaaggagtgaggcaggaagcgccagtgtggcttctgcagttggggaataataacccggccacttccaagcagacttggagcatgtagcgcccagctcagagatgagggcaggctctcctgagaggtcagggacttagcaccgtgatcatgattgtcagtcttatgtgatgatcctgtggcaggtgatgacagggtctgtgcttttgttgtcttttcagaggctgctggccaagctgcaaagctgggagagactggaccagaccatgggcctgagcatcaggtagggaagggcaggtgtctccggggtcccgccttctttgaagggtcctgggtgaagagcagagcctgcttccggctcaccagcgcagtctccagccaggcatctctgtggctggtgcggggcatttgtcctgggctgctcaggtttaatgaggcctttcccagcggatggggcagtggaacccagtgactcatcctgctgaagccttagtaacatcttcattcagaagcggaatatccacagcaaaccagtggcaggcgtctgattgccctgcgttgcggggctttgtgaaaggactctttttggtgtataccgaggaaataattgcttttgggggaaatcattcattttagggaactgtaaccagtggagatgaactgagtttttagaattaagaaaaacccactgtattaggctgttcttgcattgctataaagaaataccagagactgggtaattatgaagagaagaggtggaattggctcacgcttctgcagctgtacaggaagcatggtgctggcatctgctcggcttctggtgaagccgcagggagctttcagtcatggcggaaggtgaagggggaacaggcacgccacaatgcaaaaacaggaatgagagagcgagagagtgagcgagcgtgagtagtgttgggagggaggtgccacacacttctaaatgaccagatctcatgagaactcactatcatgaagacagacccaagctgtgagggatccactcgaggatccaaacacttcccacggggccccactttcagcactggggattacaattcaacatgaggcatggggcagggacacagatccaaacggttctcacccaccatagtggaagacgattgtctggtgcttgtagcagcctcttcacgcagtctgtgccaagctgagtgccagcgcttgggtggtgggatgtggggtggagctgccgggggaccaccctgggtgctggggatggtattcttatagacaggtagctggaccgttcccaggtctggtcctgtctgtcctcctgccccatccttcccaggaccctgtgctcatctttctccagcagccgctcagttggcccctgcccttcagtcgcggtgcccctgcaggtgaccacctcctggcagctctggtctggacccctcttcctggttgccctgtgtgcgccaggtctcgaggaggtgcaggagcgatgcttttgaaggagccatcagagcccggggctcagggcccgaggtgctggtgccgaggcggcctcttattgtgtttgcttgtgagatttcaaggcttcccgcttcttgcctgtctttcctgctgttcttggaaactaggctgagactgagactctctgaaagagctatcctttgaccacaccgtccgactgctggttctggaatccattaccttctcatcagcattactggcttcagttctctgtcacctgaaagtgcctcttcattttctttgagctttgctaagtcagagcacggcccgggctgctgtctcctcttgaactccccctgtagaacacagacttctgtagggccggcctcagcggggcctaaatgctttgtgcttctgtctgttctctgggcttattaattgcttggaaggcgacccttctgctcccaggcatactctggccagatgagaaacctctgtgacttctttcctgtgaagggacatcagaggcccccacgtgcctgatgggcccggccctgctggagggtccagtgtgcagtttgccctggagcactgggtgtcagtcgggcacgagacctggcacagctggctgctgtctctggctggtttcaaagtactgtggatcctttcagccctgttcccgcatctgagcgccctgcctgggcatggcttgtgtgagggcgagctggcctgggggtgctgcctgggcgtggccagcatgagggcatgctggccccaggggttctgcctgcctgtgtcttctgtgttcactctgccctccctggtggccaggccctggatgagggagaggaggggttggtctgtagggctggtggaggtgggctgcctgtgcccaccaccagcttaaagtgggcgggaagcaagtggcatgcatgtgtggcgccctgcagctttgatgaggaacacagatagttcttcggaggctggattcaaggctccccctgccccccgccaccaacagtaagacctgtgtcaagtcactgcgctgctctgggccagtgttctctttattgaaagggggacacggagctcttctccccaactgcgtgtgaagatccgacgtgatcgtgtacttgtggagggccctgtgagttggagaggggctggtgcgagcgtcctctctgagcagccggaggctgatggccaggaaggtggatggagccgtcctcgctgtgggggtcgacccctagtctcctgcgttggccttggctgtgggcctggtagagggcaggtttcctcacgtgctgggttgcctgccatgcctgggccccttcagggctccccgctgctccttgtgttgtgctccacagggcgggtgtctgagtgtggttctgcatcaggccgtgatctcgggtgactcacgctggacgtcagtggggtggtgctcatgccgcagtccacgggaatgcgggctggcggtcccgaatacggctcctagagagtccacgggaatgcgggctggcggtcccgaatacggctcctagaatcaccgggagggtttggtaaacgtgtgcatttctggctgcgcacagtggctcacacctgtagtcccagtggtttgggaggctgccgcagggggattgctcgagcctagatgtttgagatcagcctggggaacgcagttgagaccccgtgtgtaccaaaacaaaaattagcggtgctcagtggtgtgcacctgtagtcccagctactcaggaggctaaggtgggaggatcacctgagcccaggaggagctgtgattgcaccactgcactccagtgactgagtgagtccctgtctctaaaaaacaaaaacaaaaaccaaagtggatttctgggtaaacctgagatgcactgggctttcttttctgtttttagggaccaggtttggggtagttcttaggaatttcccgtgtctggcagcattgaatgtggtggtgaagtcggcgacagggacacagatgtggtgagaagctggggccacgggggcccccatgggagggctgagtgcatttgctgttcttgtgtggagacatgcgtgcctctgtgggcgagcttggggatcccctcctctcagccgtggggacctgaggtgacatcagatgtcctggaagcagagggctctgtggctgggagtgccctgggcctgtgccgggtgggctggcgtctgcttgccttcgggcccaggctttgctgggatttggggcttgccgaggcccgaggccccgtgggtgtggaggagctgctgccactaggtggtgcccccgccttggtgatccttcccacagcagcttcccttgggtctctctggcctagtggaccgctgctctcccaccatgggacttgcttgctgacactggggttttggtcgatggggatgtgaggggcttgtggccactgttcctgactgccttcaggggggcgcttctggctgtcccatgcctgccttgtttctgaccagtgtcctggggccctcaggcctgtgggctctgggctgtgagctcctggcgttgaggtcagacgtcctttgtgtgggcccttccctaaggacagggtgctgacgtcctgcagtcctcagagggctcttcagcctcgccccgggcttggataaaccctggctgagccccaggagagagtggcctggtcaccctcttccccatgtagggcttcttatgtcttaggagaggaggctgggcaggctggctggggtgggtcagtgaaaccatgggaagaccctgtggaacgaggtccttatgtgtcacacaggcctgggcacatgtgacatgtgcagcacacgggttcacgcaggctgggggcatgttagtttctacgactttgaagtcacaggcaaggagggacacagtgcgtgtggatgagcctgcgtgaacacacgtggggaagggcaggatgccagtgccgggagtgtggtgtggacaccctcatccttagggtgctggaagttgggctgagggagttagcagcagtgcgaggcgtgtgtctggaggcagcgatgtgatcagcttggtctcccaggagcatggtctgtctcggggagtgacttacgggtgaggaaagcggaggccagcacacaccctttgaggtacgtgtcatcctcggcaagacctcgggcacaggagggggaggaggagtaatacagagaggccagtgggaaagatggcgtgaggctggagcccatctgggaatgcaggatgcttgcttctctttggaaaatcacctgtttcagtagaatgaaagggggtgcaggccatctctgtaggcgaacagcacaaccatttgtaacaatccaagactcgtttgtgatttaaagttctcagcaagctaggaagagaagagaacttcctcaaccagctaaatgatacctgcagaaaaccagctgatataatacaaggtggacggactgcatccctgacatggagaccaggcagggtgtctgttccctgcacccctggttgcactgtactggagatcttcaccagtataattagggaagcaaaaagaaaagatggacagactggaaaggaggaagtaaaactgtacctggagacaacataattatctatagaaattcccagggaataaatgacaagccagtaggactaaaccgtgaggtttacagggtcacgggatacaaggacaatgtaccaaaatgggttatgtttctgtatactagcagtgagccactcgaggtacataccatgtatgatggcatcaaagtccatgaaatattaggaatgcatataagaaaatctgtgtaagatttgtacactgagaagcttaagacgcaactgagacattaaagatcacctgatgtagaaaaatggagacattgtaagaggaaaaatgaactcttttcccctctgctctcacacagcctctgacaccagatactggaaggtttcccccacaccaagcagttctccaggggtcaccagctggatgtcctgcagcctcatctgcacactctccacctggagttccatcagcttccaatgggtcagggcccagtcccacacatctgtgcccccttcagattccaggtgcaagtagtaggccggcatctctgcttcattttacggttttcttctcttcctctttcactgacatcagctgtacttctgactgacaggctgttaaacgaggcccctgctacccactccttgggtttcattaattggctagtgtggctcacagaactcgggaagatgctttgttatgtttagtcatgtcttataaaggatgttacgaataatacaggtgaacaggttggcagagtgaggtgtgaggagaggcgcggagcttccatgccctctctgggcacaccaccctccaggagcctctgtgtgtgcagctctgaaccctggccttatttgtgggtttttatggaggcttcatcacagaggcatgattgattacaccattggccgttggaaatcaactcacccttcggcccctctcccctcctaggaggttgaggggtgggactcaaagtcccaaccctctaatctcaccttggtgtttcggataaccaccctatctgaagctgcctgggggctgccaaccagcactcagctcattagttcacaagagacactcttctcactccagataaggagctgcatgtatgtcagggaacagaaagaccaaatatatatttcagagtatcgtaaaggtactgtggtcgtgtattggaagattcattattgttaagatggcagtttgctcaaattgacccaaatatttaacatagtcccaatcaaagccccagcagaaattgatgaactgatctctaaaatttcttttttttttttttttttgagacggaatcttactctgtcgcccaggctggagtgcaatggtgcgatcttggcttactgcaacctttgcctcctgggttcaagcaattctgcctcagcctccccagtagctgggactacaggcatggaccaccatgcttggctaatttttgtatttttgtagagacagggtttcgccatgttggtcaggctggtcttgaactcctgacctcaagtgatccacccgccttggcctcccaaagtgctgggattacaggcgtgagccactgtgcccggctgacaatttctaaaatttctatgggaatgtaaagtacctataaattgttatagccataacagtttcaaaaaagaacaagttatacagcttacactggccaatttcaagacacgttgtaaattgcataaattgagacactgtggtattaagtatagacatgtaaatcaggagaacagagtagaatgttcagaaatgattgaagaatacagtgttgattgttgtcaaagtgtccagataattcagtgggagaaagaatcttttcaccgagggtggtaaaccagtaggctcttcgtggtgaggatgagccttaacacctgtctcatgctggacacaagatttaactcaaatgacgcatagacctatgtgtaaaagtcacaaaatctggaagctagggtttggcaaagaggtcttacaatacaacgaacatgaaccataaatgaaaaaattgataaattagacttcatcaaaattgaaaacttctgctctcaaaagatacagtgaaaaggcagaccatagactaggaaaatatttgcgagatattaacatgtatctgaccaaagatgtgctccaggatagagaaggaactcttacaaattagtaagattaccatagtttaaaaaatggtcaaaagacttttaacagatactttattatttatttatttttttggagatggaatcttgctctgtcgcccaggctggagtatagtggcatgatcttggctcactgcaacctccgcctcccaggttcaagcaatcctccagcctcagcctcctgagtagctggggttccaggcgtgcaccaccacacccggctaatttttgtattttaatagagacaggtttcaccatgttggccaggctagtctcaaactcctgacctcaggtgatctgcctgccttggcctcccaaagcactgggattacaggtgtgagccactgtacccggcctgcttttaacagatactttacaagagaagatatataggtggtaaataaggacatgaaaagatggtcaacattgttagttattaggggaatgcaaattaagactgtaatcgcccaacagggttcttcttgctgcccagaaagccaatgcactgagaacggcaggtgtggcagcagagagggagtttaatgattgcagagccagccgagggaggtggacgcgagataactctcacatctgtctccctgagaattaggaggcgagggcttgagggtgttttggcgggcagcggcctagggagtggtgaatgctggttggttgtgttggggatgcaatgataggggtgtcaggactgtctccgtgcagctgagtcagttcctgggagatggggtcacaagtccaggtggcatctcttgatctgctgaaatgctaaatctgaaaaatatcccaaagaccagttttttaggtttcacagcagtgatgtctgtaggagccgttagggaagttccgaatctgacaacgtctggttacgtgactccgggtagcaggcactgtagaagagcaagctaagtaagcagtgacaggtcatggtttacccgtgcctgttctttagcaaagttcaggcccctgtagcaatgccagtcttaatctccaaacaaggacgggtgtcatttttccttgccttgaagtttaactataaactacattcctctcatagttatcttggcctctgtattagaataagcaaaaaaaaaaaaaaaaaaaagaaaagatcctgtgaggttagaagcaaggtggagtcagtaatgtagatttctctcgttacttaaaattctgtaaaggcggtttcaagactgcagtgagataccactgggcacccaataaaatggctaaaattaagcagactgaccatcctgactgctggcagagatgcagagcagccaggcctgttgcccctgggagtagcaagtggtacggccactttggaaatggtttggtagctttgtacacacttacggtgtgaccctgcagttccattcctcggtatttaatctaagagaaacccaagagaaaatgtggtctcatgaagacttgtacaggaatgtttgtagagccttattctaacagtctgagagcaggaacaactcaggtgcctgtcagcaggtgaagggatacgtggaccgtggcgtctccacgcagtgtaatgcgcggcagcggcggtgcttggaaacatgaaagggtctctcttgctgagtgaaggaagccagacttactgagtttatacttactataccatcccattgatttgaactttttaaaaaggtaaaactgagcaacagtgatagaaagcaggtcagtgatccctggagtctcgtgctgggatatgattggggtcttatggggtgctagaaataccctttggcgtaatggatgtgatcgccgcacaggtgtacacgcagcaaagctcatgacactgctcttgtcaaactgttcacgtgcgcagatcatacctcactcaagctggcctgtcaacagcagacggtcagctcttcggattagctgtgaggggaaggaaaattccttagtggcgacttggactgaattggagagtggcctgggggtgctgtttaagccagccttcatttggggagggacccatcccctgagtttatggaaggcctacggccacggctgcgtgcacctcctgggtctttgttacgtcacaggagtgctgtgaggagtggcagcatgtggggtcagtgcaggctgcagagggtcaaggagtttcacatttgatgaaaagcagaacaagctgcataaatgcaaatgaatggaatgaaaagtggaacgtgttcttcctttcctgccctccctggtgacctcactcagggctgggtgccctgtgtcacagcttcctagccatcgtcaccttgtgttctcagtattcctggggggctgttccagaatagaactgattgccccggaggtgggcagcagggcgtgctgtgcttggccccggttcgtctttctaggcaatgcctgatgagtttcctgtgtgtcgttctggaaatgtgtgtacatagaagctctttatgtactcccatcaccttttaaaattggggctccttccacagttttattctgcaactgttttcactcagtttttgacagttttttggccccagcgcaggctggtctgctgaactactttaaagaactgcagggtgtgctggagtgcagacggactcagactccagcagcccctgttgatggacacttagggtgtttccagcttctttccccaattagccatgctatgctggttgggtaaattcttaaaaggatgatttttagttcaaaagagatgtgcgtttgagactcctagctggtgccacaccgccctcccgaaaagcatgagtgctgtgcgctcccgtcacggcgtgtgactgccgtcacctaatgggggtggtgtgctttcaacgtttctagagagattcagctcgaagtcacagtacagtgaggagagcaggcatcttcaaaggcttggcttttcaaaactgtcatttagcagctcccactgagggggaccctatgaaataggaagggagtgggtgtcaagtcctgtagccgagcccccacttcagggaggaaatcatttgctcgtggccaagatgccgctgtttttggctccttgcctgtcccgttgtgcctgaatctggccttgcttcccatcccggcgggtgggcattatacccgtcagcaagggcaggcctgagggggtgaggaggggctgcagaggaggctgggctggggaggtgggaggcgggcattgctggctcagagtcctggcagctgtgcccacctggaactgctgacccatcccctgtagtcaaagctgggcacctgtcagtgctgacctggacattttcccaaaaacttttgtagactggtcagatgacaagtctcagggcccagcttccctgatgtgtgaggccaattaggaggacagtgaggggatgcatgattttcctctaaggaagggtctaattgaccagcctggacagttttattatcctagttaccgtgcgcgtgatttgtaattacccggctgttgagttgatcaataccagacgccctggtggtgcttgggaaggtgggcgactgtcaggtatgttggtccattttaattggcgccggtttggttttctttggggcatgggaggaggagggggagaagcgtttggccttctggctacttgtgtgagcatggcccttcttctgggcctgcatgccggatgcctcgtggtctgggccacgtttccccttttcgtttgttcattcgttcaccatgagctgctcttgtggagcccatgatctggagggagaaggatccctcaggcctgtgcgtctgtggtgtgcaggtcccaggaccctggagctggagagtggcgagtgtgctgccctccagaggtgcaggccagggtggggcgtgagccaggttcccagctccgtccgagcacggtgcctgccatctctcctcttctcaaccccagctcctcctgtggctgagtcctggccgctttctgccttggggttgtgttggttttccgtaaacgcatcctctcaatcctgagcattgtgagttaagagctggggtctccctttagcgcccctgagccagacgtgcagtaggcgtgtgctgagcctttgaagagtggaggaccgagcgagggcgtctctgtgccttgcagttggtggtgatgtatgggcggagcctccagtgctcttggctgctgtgacagggcccccctggggtcctgcactatcccagcgagacccccaaagcaaggccagcagagagcttcctgacagctgcctcgctttggcgacggccctggctggggtgcagcctgtgcccctctccgcccccttgtgaagtttcggatgggcgttcccagcagtgctgacaggctcacgccgcccttgggcttcattccaggtacggtcgggcaggctggagactgtcagagtctgggggcggtgctgtgggtgttgggaccccgcagggagaggcgagagaagggcttcccagaagagaccgttgggctccacccctgcatgtgcctgactgcacagacagctgagtgctctgcggcgtgtccgggtggaaacgctatcacttggtctcggagctctttttggggcttttctccaagctttgtagatagggctcttctacttataggtctctttttaaattgattttaaaaagtctaaggccagagtgacaggctttagacaagtccggctgccgtaggttccaggatttattttagaggaggcggtggcatccctggtggtatctgggctggtttttactcatgggtgcttactggggtcctgttgcgtgctgtcccctccttgtgggctaggggctcccagggtgtccacgtccctacttttacaggtagagcagggggtgccctggcgtggaatggaggaagggtctgggcagctttgtgacagggctggtaggagggggattttgacaggcggcttgaagccagcgccagccgagggccagaggcagagaagctgaaggcctcctctgggcagcccaccactacctgcccttctctccgaggacttcccagcagtgccatggccttcggagagctggggtctcaggcaggctacggggctccacagctccccacccaacattcctcaacgtcagctttggggctgtgaggtgtgacctctacaggatcacctggggtcactccctgcagccagctgtagctgtcatttgtgtcaggagctgctggtcttgcctgcaccacccacccttcccgccctccacctaccctgcgtggcctgggttcttgggaggaacaggagatcctgagctgttgaattcctggaacccacggtcactcggcacccgcatcccgctcctcccagctcctgcacgcttctcactggtgtggtcacctggaatcaggtgccctgattctgctggacaggcgggaggggaggctgggccgaagggtggaccagcctttgcacgctcagtggctgcaggggggccgtgtgcatgaagcaggcggtcctcgtggtagcaccgtttgtgcagagccgcggtggggagagcgggcttgcgttcacagaagtgctgtgagatgatcacttcatcacaagccagtcagcaccagcctgtggggcggctcatgtggactaagtgatctgactttcctggcttttgtttgacgatgtttccactgttatccaggtgcagagagctctgatctcccacgatcggaagtaccgtgtgcgtgtcttacctgggcagaatgcagagaccttcactggcagctgtgtgtggaccctggggctctgttacacagccaggtgctgaggagcagggctccgagccaggccagcgaaccttccttagaccccctgtgtgcaggcctggtgcctggtgtcgggggcccagtggagaacaagatccggctgttgccatgggactttcgtctggtggggagtcctgaggaggatgtggatgaggtggagaagaggttccaggtgaacgcaagtgtccaccctgcattccagggtggcaggcggcccggggcgggtgtggggtggttgggtgggcgccccgcgtgctatgttagcgtagggtggtgcacacctggccggcaggccttggtcccgctcttcaccctccacctgtcgtgggtgcgccccgggaggggtggaggatggagggcaggcgtgggaagagctctgagacccttggcttcatggagagtgttgggcagttacccctcccttgccctcgggcctttgtgagtgtggcttcctggaactctgggggatttgtcaccagtgactgcagggggctctcccatccctttcatccaggcttcactgtctgccctaagctggggactggtccagctgacctggatggtgcggagtgtgggccctgctggccagcatggcgttgggaagcacctaggtgggtggtgggttgggttgtggccttaccgcggagtctgggctgcagctgagaaagccgtctcctaggaccaggaatctgggtttgggaggctggaggtcttggcccagcagttcagtggctgcccggtgtgtctgcctggcctggccctcgtctggtttccgttgtctgggaggcacccctgcccgtgccaggcggggcactgcgggggcgcggatgcggagtggaagactgctgatttaggaatcgaaactccagggacatccgtgtagcagagtgattctaagatgattaagaaaaccatcaatgatttaaagaaagtgttcactgcagtccttattgagcggtttgccgcgtgcagggcatgtgggggtggcgcaccaggctgcaggcgcccttcatgacggcaggcaggggacctcctaggagtcttggctgtgacacgtgaggtatgaaggccagaaaggtgaacgtgtggaatctgtgacccagaagtaacaaactcctttcttggagagcagttaggtattccattccttagtccatatgccaacatttaaaaaggccaaaaccagaggcctagaaaatgtatctggaagttgcagtgagaccgtttttgatcattgtggccttcctggggctcagtttcctcgctttgcaaatgccattttggcagggatctgctgtggggcatctccgtgcaggtggagctggagttgcgcatctttctcaggctggcatcatacaggccccagtgcactctggcagggaggggcagccccctcctggatagccccgcccaaggccgggaggactgtgaaggggggatcccactgcctgacctcagcctgtcgggccccacagcgcgtctctctgtggactggtcgccggcttcctgtggcctgtgtgtcctccgagtggctggagctttggaaccctattctgtagcttggagctcctgagcctcaaagggcaggggcctggttccttgcccatccttgcccagcctgatggcctgtgcttgtggactgtacatgggcacctgctttaacacctggaggagtaggggctaccaagagcatgtggctctgggcctccctgggagagtcactcagcggcaggagaactgagtgggacacatcagggagtgtctgtctcatggacgcctgttggcctgcagcctggagagggggcctgaagtgtgtgttccatgctcttgacccccaggaagcactcgcctctgttgaaagcctcgtgccgcagagcgcgattgctgtcccgggtggacggccatcacgggctccttgctccggcgatgccagcgctcctggtgttgtgtgtggctggctcccccttgtctcagccctgggcttagagcaggccaggtgctcaggcagtggttttgttgcttgaaggggggtgtgtacctggctgcagcctgtggagagcgtgagtggctggcagaagcaaaggcgggctcttgggagatgagagcaggcagccggcctggaggcttccatggggctggtcagctcctgctggctcttcctggcacaaatccacgctgggctgggtgccttggctcacacctgtaatcccagcactttgggagcctgaagtgggaggatcgcttgagcctgggagttcaagaccagcctgggcaacactgtgagaccctatctctatttttaaaaataaaaatataaagataacccttcctccaaaaaaaaaaaaaaaaacccaaactcatggtggaccttgggatgagcgggggcgcttgtggggcagaactgggtgtggttgccccgtcctgggcctgttcccaggcctgctcttagaggaggggctgatgggccctgtgggtgcagggagatggggtcagtcacaggctggggcctgggggctgggacctgggggctgggacccgggggctaggaccagttttggctctcaggcagggaggggttgtgaactctgttttgggaatgtgtgtttgaagtgtcagtgatgtagccagaaggaggtgtcagacagcagccgatgtcaggcctgcatggctcctagaggagccctagggctggcctgcccagtgaggggcagggatgagccggcctaggggagtggcagagccagaggagcagacagctggcccgagtctggagggattttggcgtttgcaggtggctttgagcctgagggccagtgcctcaccgggtcagagagctctgcagcccgccagtcctggtcgtgcctgtgtccgagcttgggcccgtgtgcagggagaaggtggctgtgcagtgcacgtcgtgtgtaccaggcgtcggcggagtgatgcgtgggtcggggcgggagatgagaggaggagtgaggagaggctagaagcctccagagcagtggggtttcttcctcttcttcactggtgagtgcttcttgaacacataggtgtgcaggcctggtgctgggtgctggggatacagctataagtcaggggctgttttccagtcctctcagatctagccgggcatatgtctgctaggtcaagcgtggctcctgaagagatgacacttgagaggctggcagcatgttccagatagggtgggtgctggcagcacacaggttggccagatgctgcgtgttcggacagtgttgtgtggctccagctggttctaaccacagttctcctgggatgtggcagaagctggacaggttggcagggatctgtcctgtcctgagggtggtttggaccgcgtcctgcaggtcacaggagccgcagaaggtcttcatcagggaggagcacatccgccaattgtgaaggggcctctttcctcactgaattcgcagggcgaggacctggcgccttggcaggaccctgctggtggaagtccctggggctgtctgacccgctgcaggtttcagcagccccgaagtgtggggagggtgggcggtgtttcctgttgtcagttgagagcctcatggagtaggagccgtggagtcagccgcgttgtagtgagagttagaattgagctgcactgttcctgtgagcagggagcccgaggccttctgacttctgaagagggttcgtgttgaaggccagactctccctgtttttctgtttcctcttcaggtgaatgcctgttcctttgtgaccacagtgtctgtgggtagcactgtgattttggagacgctcgtttgtttgttcatctgaacatttatttggagacctgccgtttgccaggctttgggctggctctggcgacgctgtgacgagcacagcacagtctgcccacgtagtgcacacacacagacagctttaaacaatgaaaacaacaggggtgcctcctcagatgcaatcttttggaagatgccgcaggagcgttttgcgggagtatcttagttggagacggccttgttggatatgaatgacgctggtgggaatgaaggccagacgttttccctggtttggaaacaggtggcttacaagagtttctagagtttatttgtttaaagacagagcctgttctcaagagggtcttcactttgctggcaggatggcactgttgacggtggtggttggctctggagagctgctgtgtagttgacaaagcctgttgataatcagcgtctcattcgttcttcctcagaaccctgtggactaagctgggttctgggaggggctgactggcccaagggcatccagtgaatttgtggccctgttgccggaatgcttggctgatcctggagtatggtgagctgtgccctcaataacctccatccatctggctggccacatggtgccatgcagctggatcctgcatttttgtgagctgatcagcccgatgctggcactgaaaggattctgttgggagctgccatccatttagcctgagcggaactcagcacatgtgcgggcatgaagcccatcagctgatagcttctctttcagacctgatggctcccagccgaactttggcaagaaggacctaccagcctgctggagggctgacctgcctgcctttgctgggagccaagcacctcctggcagttctgggatttggttttcagtgggaggaggctctctgcaaggtagagtaagagcagtaattacttgggagaggaagcgtttaacttctgaggctgcaacacaatactatcttgttcgcggaggtggctgagttagaagattagcaattaattttttatcaggtgcaaactactcttcagtttcatggaatcaaacagtcctcccacagcaagggaggggcaggcttccaccccgtgtaatttttcagagcactgctgtttgtctgcttttgagctgataggaattatttacgagtctatttggaggacattttgacacacaattcttggtattcccatttgctctttctagtttttacttttcctgcattgctagcgtttactgcaattaggtctcaggagtattttgccttttattaggattgcaattacaaaatgcaggtatcaactaggttcctttaaatcaaagctcactttttattgactcggataagaaaagtaggtatttttagtagactgagttgaaaagagtgtcattggtagctattacaagcatttcttttagtttaggtgtttttattgtttacgagagcttagctgaagtggcatagataacccagtaggggtcactgctaagttatctgtaagttttctaagcttgagctttagattcaaatacttttttttttttttttgagacagagtcttgctgtgttgcccaggctggagtgcagtggcatgatctctgcttgctgcaacctcagcctcccaggttcaagcgattctcctgcctcagcctcccgagtagctgggactacaggtgcgcatcagcacgcctggctaatttttgtattattgtatttgtttttttagtagagatggggttttggcatgttggccaggatggtcttgaactcctaacttcaggtgatctgccttcctcggcctcccaaagtgctgggattatcagtatgagccactgcgtccagcccaaagacttttaataatagaaaaggtactttctcttgtttcatcatttagtatgctaggttttctttgagtttctgtaactaaacagtgggtacctatgataggttgggatggatttagggcagagtctggtacgttttttctgtaaagggctgggtattaatagtaaatatttactttgtagctttgggggccataaggtctctgttacaattagttggctctgcctttctagcccagaatagggtgattagccctcacggcttgtctgagactgaggagttttgcttgggaggtgggacctttcatgtgaaaactgagatgacccaggatgaaacaggactgtcactgattttagtgcaaaagctgctgtagacagtgcgtaaatgaatggatatggctgtgttccagtaagactttattttcaagacagctggggtgggagtaggtttggcctgaaggccatgcctgctaactcctacctgaggatacagggctagccatttaattttggtttaaaaaatccatgcagaggctgggcatagtggctcacgcccgtaatccccgcactttgggaggctgaggtggtaggcagattgcttgacctcaggagttcaggaccagcctgggcaacatagtgagacctcatctctgcaaaagaatacacacacacacaaaaaaattagccaggcatggtggcacgcacccatggtcccaacaactcgagaggccaagtcaggaggatcacctgagcccaggaggccgaggctgcagtgagccgagatcatgccactgcactccagcctaggtgatagagcaagaacccgactcaaaaaaaaaaaaaaaaaaaaaaaaaatccatgcagagccttgctgccttttccctgcagcttttctttcccatgcagagccttttgctgcccacacagcatcatggtggtttcttcctttccagatttgggacagttgggcgacggtgtggccttgcctgagggtggttgtggaagagagcctagggtgagactggcgtctcccggatcgcggctcagcacctgctctggctggagccttggcagtgcacagtgaggttttccggaggaatctggagttacccgcggccgtgttaccccttggtaataattttgaagggataaaacccttataaatttgctcccagggttgagaagtgctcatttctgtctcgcctttttttctggtagccgagggttcccaggagcacatattgtgatcacgtctgttccattcaacaaatatttgttgagggcttatgacgtaccgtggtgtatactggctgggagatgcagcagagagcaggacgcacggtccctgtgctgaaactcagcacagcaatgtggtgctgggggcggaggcggggaagggctttgaggaccaagagttggagggccttgctgttctaggacaaggaccgtcctctgggcggggacgctttctctccaggacgtggtggctgtcggagctgggtggcccttgtctcaccccggttgcttgggcaagtgagtatgctggggcgtggcttgggccgatggtttgtgagcctgcacctgtcagcctcagtttgggctccctgtggggcgtgtgagtccctgttctgactgagggttgggttagggtttccagcctccctgcccctgggaagaggctccaccctcctccacgagtgctgagctccgggtctatttgtactgtgaggagttgcttttgtctccatcaaaaacatgaaccactgtttggagcacttccatttactgacaacccttgccaaattaattttatttaattatctcccagggctaagcttgaatacattttgtgttaagttcacagttttttccttttctaaacgaaatggacttaatatccttgttaaaatctgattaaaactaaaattgagttttttgaagtctgattatcccatgaaatggaattttaaacctaattacagatggatttgcatatacttttcagcaccattgaaaagaaacttggtataaatttattaatgacatccttttctctcgtttccttggggcatgacgttagtttaggagcatgagggaggtggggagaaacaccacccttctccccgcccttccttagaattttttaaaaaactttactctgtggagaatcagttccctaggagcctggggcatagtcacactttcattctcatctttgctgctttaccggcttaggtggctgatagttttcctgaattgtttttcaatactcagagctcttgtctttcggaagatggaagaggagcatgcacgatcatagctgctggtgtgtcttccctgtcagcttaaaacgcagatttggccgggtgtggtggctcacgcctgttatcccagcagtttgggaggccgaggtgggtggatcacctgaggtcagaagttcgagaccagcctggcaaacatggtgaaaccctgtctctactaaaaataacaaaaattagctgggcgtggtggcatgtgcctgtaatcccaatgacttgggaggctgaggcaggagaatcgcttgaacccaggaggtagagattgcagtgagccgagatcatgccattacactccagcctgggcaatcaggacaaaactccatctcaaaaaaaaacaaaaaaaacaaaaaaccccatggatttatatttaacgtgctacctccaccctgatttaattttagtttttaattttaagttttattttatgtatttttttttttatcgagacagaggctcgctctgtcacccaggctggagtgcagtgacgcgatctcagctcactgcaacctctgccagccgggttcaagcaattcttccgcctcagcctcccgagtagctgagattacaggtgcctgccactgcgcccggctagtttttgtatttttagtagagacgaagtttcaccatgttggccaggctgatctcgaactcctgacctcatgatccgcctgtcttggtctcccaaagtgctgggattacaggcgtgagacaccgcacccggcttaattttttttaatttttttgagacagagtcttgctttgtggcccaggctggagtgtagtggcacaatcatggcttactgcagtctctgcctcctgggctcaagccattctcccacctgagcctctggagcaggtgggactacagacacttgccaccacgcccagctaatttttgtatttttagtagagacggggtttcaccatgttggccagactggtctcgaactcctgagctcaagtgatccgcctgcctcagcctcccaaaatggtgggattacaggtgttagcctccaccctagttttagatacatttgtattattaaaaaagtaaaaacaaactctaaatgaccattaggtgaaataaacaagaaatttccaaagggccatgttcctgttctttgagaaatcccacttttccaggagggctgtttgctattgtgtctggactcatgctgcctgttgcgacttcctagtggcaggtggaggtaacaggctcccagcgtacttgccctcagtctggctgtcaccgtggttttgtttcgtctggaattatgtgggaatggaatcatacgtcatgcagtcatttgtgtctggtgatttcactggcagaatgttttctgaaaagcattcattcacatttgttgcttgtatcggttgtccttgttatatcgaacggatataccataatttttaatccggttttttgctcttgcagataaagattctgtgaacatttgtattcaagtctctttatgtatgttttcctgtctcttgggataatacctaggagtggggcctctgggtgatatggtatgttttaattttagaaaaagctgatgagccaaagtggctgcctaattctgtcccctggccacccgtgtgtgagaattccgctggccccacatcccgagctctttcattgaattccgctggccccgcatcccgaatgcattcattggccaccttcactttagccatcctggtgggtgtgtgcggtatttccttgtggccttcattcctgttgccctggtgactaatgatgttgaacatctactcatgtacttaacttgacggccatatatcttcttttgtgaagtgtcttttcaaagtcttttccccattttttaattggactgtcatcttctgagttggcagagtactatatatattcatgacagagtcttttgtcagatgtatggtgaatattttctcccggtacgtggcttccttttcattttcttagtgtcttttgaagggtaaaaacttttaattttgctaagtctgatttatcaattcattttctttatggtttgtgttttttgtatctgcctaacccaagcttttagaaactttctagctttaactttactgttaattttgagttaatttttgtgtgtagtgtggtcacagttgagggtcgctttcctgccccacaatacgtatgtctgtttcccatttgaatttccttggcacctctgatgaaagcctgtcagccatacattcatgggcctttgctcgaggtcttctttcattgaatcatgtgtctgtcctttctccagtatggtaaggtcgtaattactgtcacttcctaatactctttgaaagaacatagtaagccctccagctttttctttgtaagaattgtcttggctattttagtttttttattttcagataaattttagatttagctttcagtttgttttctttccccccatttactttttatttcgtttattttttcttgccttagtgcactcactgggacctccagtgcagttttacctgggcatggtgagaatggctgtcctggccttgtcagccttagagggaaagcgtttagattttcctgaagcatgaggttagttttagggtcttgcgagatactgttcatcaggttgaggaggatgcttttcttttccccgatttgttgtattgggtcaaatacatatacaataaaattgactgttaactgtttttaagtgtacagttcagtagctttaagaacattcatattgctgtgcaaccatcaccaccatccacctccaaaactttatcttcccaaagccaaactctgtacccattaaacgctcgctccctgtgctcccccgttggctctaggacccaccattctgcttcctgcctctgtgattttttactacagtagggacctcatagaaggagaatcatgaaatatttgtccttatgtgactggcttatttcacttaacataatgtcctcagggatcatccatgttgtggcatgtgccaaaatgtcctttctttctaaggctgagtaatattctgttgtatggatagacgatccgttcttcttatccagtcacctgttgatggacacttaggttgcttccacattgtagctactgtgaataatgctgctctgaacacgagcgggcagatatctcttagagcccctgctttcaacctgctggatcctgtggttcaacttttaactattttaggagccactacattgctttccacagtggctgtaccattttacgttctcatcagcagtgcacaggagttccagtttctccacatcatcaccatgtgatgtgattttttttttggtggtagccatcctaatgagtgtgaggtggtgtcttgttctggctttgatatgcatttccctaatgattagtggtgtggagcaccgttccatgtgctccttggccagttgtgtgtcttctttggaaaaatgtctatgcaggttcttcgcctgttcttgaatcgcgttattttcattgttgttttaggagttcccttgtatgttttgaatatttttctcttacagatacggtttccaaacattttctcccattctataggttgtgttttcagtctgttgatagtgtcctttgacaaatttaaaatttaaaaatttaccaagatttcatttgtctattttttttttgctgttatctgtgcctttgatgtcatatccaagaaatctgtgccaaatcccatgtcataaaccttctcccctgtttttttctaagagttttatagttttaggtcttacatttaggtctttgatttgttttgggttaattttttgtgtatggtttaagggcccaacttcattcttttgcatgtggagaccagttttccagcaccatgtgttgaaaagcttgtccattcctcattgaatggttttggcacctttgtcaaaaattatttgagcatacgaaagtgtttatttctgggatctctactgtatttcatgggtccatatgcctgtcattctgtcagcaccacactgttttgattactgtggctttgtagtaagttttgacttaaagtgtgactctttcaactttgttctaacttttcaagattgctttggcgagggacctttgggtcccttgagattccatatgaattttaggatagattttcctatgtctgcaaaatatttagttaggtcttgatagggattgcattgaacgtctagatggctttgggcggtgttgacatcttaacagcaagtgttccacacgtagtggtttctggaaggttagttgtggtacggaataatcttttcaaactgtcgtactaaaattcattggtctcttgcactttgaatggacctttatccatgcatggttatgtaacatcatacattgctcatttgaaaatatcgacgcactgaattatgtaggtcttttattatgccttattaaagaaattacaagctaatcaccacaagttattgaaaagtctttaaacgttaggaatccatcaagcttgtggtggtagatacaaatttttaagaatttagatatgtgtttggcagcttgagttttattattgtcaacaaatactcgtggttgtattctttcaaatgataacgtttatttaattcgtttttgagaaaatgtctaccagatgctcaagcctgagtaactattgttggtcagttagtttttaagtaaaatattttacataaaaagggctagttcagttcacaactcaaacatggaagaccaaccatcgcactttagtatgcaccagaaatgtcttacatgtgctttctatttcttcacacagaatgttgagatcttatcaaggggttaagatttaatgaagtgaatattttaactgggcccagtactcctgtagttccagctgctcggaaagttgaggtgggaggatggcttgggcccaggagtttgtggctgttgggagctgtgattgtgcctgtcagtagccattgcagtccagcctgggcagcatagcgagaccccacgtggtgcccctggtttgttttgctaacgtgttatacccatcagtgcttttgtatcttcagttcaaatgtcagcacagttagaagaaaaaaggcaaataatagcttattattattattccttgtttttttggagacagagtcttgctgtgtcacccaggcttgagtacagtggcatgatcttggttcactgcaacctcaaccttctggattcaagtgattctcccacctcagcctccccagtagctgggaccacaggtgtacgccaccatgcctggctaatttttgtattttttggtagagatgaggttttgtcatgttggccaggctggtctcgaactcctgacctcaagtgatccacttagtattattatgaaaatagttttgatggccaggcacagtgactcacgcctgtagtcccagcactttgggaggccaaggtgggcagatcacctgaggttgggagttcaagatcagcctggccaacatggcgaaacctcgtctctactaaaaataaaaaattcgccgggcgtggtggcgcatgcctgtaatcccagctactggggaggctgaggcaggagaatcacttgaacctggtaggtggagcttgcagtgagctgagattgtgccactgcactccagcgtgggggacagagcgagagtccgtctcagagaaaaaaaaaaaaaaagaaaaagaaaatagttttgatgttacaagactgcctagaatggtgtctgcagaccacacttagtgaactgttgtcctagcgcttagtccctcaaggcgagaagaggctcacaagttggactcacatgtgatcctacagctctgtgacatgcttttcaaaaatattgtacaggataatgtaaatccatcctcactacaaagaaagctcaaacagtacagaattaaagtgaaactttcttggatttctctgctttttcaaattctgctgtatcccaggttaacattagcagtttgctataagtccttacataatttttatgtgcatggacgtcttacgtacataacaaatggcatcatacggcctgtattgttatattattttcccttggattgagttacttgaaatgtctggtgtttactctttagtagccattattccatcgtagaatgcacatattttaactatttccttattagcatacactacagttgttgccaattttttctttttgctattaacacacagatttagtgaataccatttcattaaacatattttttaagtgtatctgaaacattctttttattgatgggaatgctaagacatagagtatgaatatttaacactttaataatttttgccaaattacgttccaaaattatacttctgttaacagtacttaagattgcccatttttctgataacattcattgatgttgttagtgtttccgatttttgccctttacttaaagtcagctgctgtattcttagcacagtgctttctgtgacagatgtttcagatgacagtgcttcctgcctgcaggctcatctgtctgccctggtagctttcaggctctcaggcaccctccctaatggaccgactggggtcaagggctctgaaaatgctgcccaccctggcccaagggcctcctgaacaggtaggctgggggtgggggtgagtccggtggcttagatgacaaatggaggtagaggacgcattctcgcctgttatttcgatttttttctctcctcaccctgaccgtcacgttctcaccttttccacctcaatccccagtcacactagcttcccaggattaaaatggtctctctctcatgaaacttgtttagaaatctagaagcattaaaaaaaggaaaaaaaaaatctagaagcatgcacgtggcttagaaaatgcctttgtgttgccagatgcagttcccttgctttgacagtggcattcaatgtggtcttttaaaaaaagaaactatctattcctttaacatttttttgagataataattacatacagtgaaatggacagatcttatgtatataattgagtgagtattgaaaatgtaccacctgtgtcatcactgcctccgtcaggctgcagaaagtttccattacctctggaagttccttctcgtcccttcaatcaattcctacccccgggagacaagcactgttctgatttctattaccataaattagttttgtgtgttcttgaattgtaaataaatggaattgtactgtgtttattcttaaattgctgtcatcttttgcccagggctgggactagggggaggcgagagagtgtgggatctacactgcacaccccaagagtgagattctccgagcaatcacctcctgaaagtttgtacgccggcatctctcttgcttcacccttgtcctggccctgcttttggacaacagagtgcttttgaggttcagccctgttttggggagatgagtggtacattatattttatttttattatttatttattttttgagatggagtttcactcttgtttcccaggctggagtggcatggtgtgatcttggctcactgaaacctccgcctcctgggttcgagtgagtctcctgcctcagcctcccgactagctgggattacaggcgtgcgctatcacgcctggctaatttttgtatttttagtagagacagggtttcaccatgttggccaggctggtctcgaacttctgacttcaggtgatccgcctgcctcagcctcccaaagtgctgggattacaggtgtgaaccaccgcacccggcccagtggttcatttttaacttgtacgaatctgcttgtttgtttccccgtttgctgtccgaggacatctgggttgtttcccagtagctgcctcttgtgagtatagctgtggttaattcacatccacatctcatgtgctcctatgtttccattctctcgagtgagcacccagaagtcaaattgctgggccttttaatgagtacgtgtataacttcataagaaattgccaaactgtcttccaaggtggtggtatgattttatgctcctacctggaatgtatgagattccatttgcattatattttcaccagtatttggtgtggctgtttatttttaaaacatcctttatttattccagcggttgtgtggcgttaccgacttttggctttaactcacgttccctaatgaccagttccctagtcagtgaatatgttgagccctttcttttttttttattttaaaatttttatttgagacagagtctcgctctgttgcccaggctggagtgcagtggcgcgatctccactcactgcaagctccgcctcccggattcatgccattctcctgcctcagcctcccgagtagctgggactacaggcgcccgccaccacgcctggctaattttttgtatttttttagtagagatggggtttcactgtgttggccaggatggtctcgatttcctgacctcgtgatccacccgcctcggcctcccaaagtgccaggattacaggcgtgagccactgcgcccggctgagttctttcttttgcttaatagctttgttttttatttttatttttatttttatttttttattattattatactttaagttttagggtacatgtgcacaacgtgcaggtttgttacatatgtatacatgtgccatgttggtgtgctgcaccgattaactcgtcatttagcattaggtatatctcctaatgctgtccctccccgctccccccaccccacgacagtccccggtgtgtgatgttccccttcctgtgtccatgtgttctcattgttcaattcccacctatgagtgagaacatgcggtgtttggttttttgtccttgtgatagtttgctgagaatgatagtctccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatagctttgtatctgttccttgggaagtgtctgttcttagtcttttgggaaattgtattggtttgctttctttctattattgatttttccaagttctttattctggatacaagtttttcatccagtgtatgtcttgtcaacatttttgccctgtctgtggcttgtcattttctttagtttttaaattattaaaatatacatgactactactgtaagactgactgttgttcttttttttttttttgaggcagagtcttgctctgtcacccaggccaggatgcagtggcgcgatcatagttcacagcagcctctaactcctgggctcaagtgatccagcttcctgagtagcttggaatacaggtgtgagccaccacacctggctaattttttctcttttgtagagatagggtctcactatgttgtccagactggacttgaacttgtgacctcaagtggttctcccacactggcctctcagagggctgggattataagcgtgagccaccatgccctgccgcttgtctgttttaaagtgtttaatttggtggtttttagtatatttgtaaggttgtacactcatacctactgtctaattccagaagattgtcatggtccccaaaggaagcccagttggccgaagttccctgttctcctttccccagcccctggcagtcactcctctgctctttgtctctgggtttacctgttctggacgttgtgtatcagtggaatcgcaccataggtggcctctgtgctggcgctttcctctcagcacgttctcaaggggcgtctaccctgtggcacggatcagcgctcccttccaccacatggcacgtggtcataccccattgtgtcatcagagctcatttcagtgacccattcatcagctgtagacatttgggttgtttcactttctggctattacgaacattcaagtacagatatttgtatgagacctttttttttcacttctcttgagtggaaacactgggttacatggtagctctttcttttttaggaattgccaaactattttccatagtaactacaccattttacattcccaccagcagtatatgaagattccggtttctctgaatttttaacccttattatgatgtcttttttcttatggttagcctcgtgggtgtggagtggtatcttaaagtggatttttttttttaatgactgcatgatttttcattggatggatataccataatttaaacaatgacttattgtgggacaaaaaattatttccagttacattttatgatcttcattgtttatatcagtagtagtttatttttttaatgggattttattttttatttcaatagtttttggggaacgtggtgtttgattgcatggaaaagctctttagttgtggtttctgagattttggtgcacctgtcacctgagcagtgtacactgtccccagagtccattatatccctcttacacctttgtgtccttatagcttagcttccacttataagtgaggatgtgagatgtctggtttttccattcctgagtttcttcgcttagaagaatggtctccaactccatccacgttgctgcaaatgccattatttcattcctttttatggctgagtagtattctatgatatatatatatatatagagaccacattttctttatccactcggttgatgggcatttaggctggttccgtatctttgcagttgcaaattgtgctgctgtgaacatgcgtgtgcacgtgtctttttcgtagaatgacttcttttcctctgtaggattgctgtctcaaacggtagctctactttcagttctcgaaggaatctttgtactgttttctgtagtgattgtactagtttccattcccacgagcaatgtaaaagtgttcctttttccaccacatccacgccaacatctgttattttttgacttttaaattatggccattctggcaggattaaggtggtatctcactgtggttttgatttgcatttccctgataattaatgatatttagcattttttaaatcttatgtgctttttaatttgtatttctcatggctaacgtgtggaaacgtcagtggctgcatagaacagagacacaaacattacagaattagttcagaaaagtcatgaaacaagtaaaaaacaactacagctggcagcaccagcagccagccctggcaagggcagagaatctgattccagagttgccgcaaaattcggaagacatgcaagaagcaagaaagtataattcatacatggtggagaaagcaatcaatcagtagaagcagaatatcaataaaaagaaactataaggagaaaccacatagaaattctacagatgaaaagtacagcaactgaaatgaaaatttggtagataagctcaccggcatatttgagcagcagaagaaagaatcagcaaacctgaagataggtccgtcaggattctccggtaaggggaataaagcagagagagaagaaaaatgaagacaggatacgtgctttctccacttctgttcagcattgtgctggaggctctacccaggacgtttatgcaaggagaggaaatagaagacatccagattggaaaggaagaagaaaactgtctctatttgcagaagacatgattttatacattaaaaaactgaaagaatacacatttacaaaattattagagctaataaacaagttcaacagagttgcaggatacaagatcaatatttaatattatatttaatataagataatgtttaatattatacgttagcagtgaacaatctgacaacaattattatccccagagatattttgtctaattttctcattggcattttgctttgtttcagatgctacagaaacaagcccagtttccttgacagttgcactatttttattacaaaacctcactagacatttcacatttgaaaactctcagtcgtaaattaaccatggccatcaagtctctgtgatctgtggacagttttttgtttgcctctaatgcttgtctggaagttcggcatgctttaggctagatgctcggtcttaagcaaaggccagtctcagaatgaatattagccagagatttcctgagatacctagaactggtgagtccttgatgaggagctccggtgcacgctgggccaggtggtggccactctgcctttgccctcatttcctgcttgctcagagcttcaaggtgagcaggagggagaacccagggccttcacaggcctttccgagcctgtgcgcaacatgcacggacatggccccttagaatctcagtccccatggacagctcatttcttagcttttctgtgtcagcgttctggtgagtcttttgtttgccactgctgtcactcaggcatttgtgatgttgaagtggttgacagactcattccccaaccaagtttttgccctgggagagattaggggaggtgaaatcaagacaggactttctttcttttctttttttttttttttgagacggagttttgctcttgttgcccagtctggagtgcagtggcacgatcttggctcactgtgacctccgcctcccaggttcaagcgattctcttgcctcagcctcccgagtagctggaattacaggtgcctgccaccacgcccagctaattttttgtatttttagtagggatgaggtttcaccatgttggccaggctggtctcaaactcctgacctcaggtgatccacccaccttggcctcccaaagtgctgggattacaggcgtgagccaccatgctcggcctaagacaggacttttaattgggatcttaaggtagtaagtgacccagatgggtcaagtaataactcttctttgggaatggtattttgagagatgccagccccattctgttccctctgtcctgggaatgtagagtgcgatttttcttttttttttttttttgagacagagtctcgctgttgtcgcccaggctggagtgcaatggcgcgatcttggctcactgcaacctctacctcccgggttcaagtgattctcctgcctcagcctcctgagtggctgggattacaggcatgcgccaccatgcccggctaatttttatatttttagtagagacggggttttaccatgttggtcaggctggtctcaaattcctgaccttgtggtccatgtgcctcggcctcccaaagtgctgggattacaggcatgagccaccgtgcccggtctagactgatttttcaaggccaccatggagttgtggtgtgggggctgggaccagggtgagttaaaatgccccaggcgcactcttcttgagagccacctgattttcttgaccaaacgttcccggattgctgtaagcctttggttagttttcagagttcaaaaatctgattctgaccgttttagtcactcttctgttgcttttatggtggagtgaacttccataggctcttactctgacatttttactgagatcttaatggtgttttggatgagtaaaaatttttgattttgatgaaatccaattcatcaattttttcttttgtgatagtagtttttcttttcttttcttttttttttttttgagactctgtgtcgcctaggctgaagtgcagtgatgtgatctcagctcactgcaacctccgtctcctgggttcaggtgattctcctgcctcagcctcccaggtagctgggattacaggcgcccgccaccacacccggctaatttttgtatttttagtagagacagggtttcgccatgttggccaggcttgtctcgaacttctgacctcaggtgatctgcccgccttggcctcccagagtcctaggattacaggcgtgagccatcgtgcccagcctaatttctgtgttttaagaactgttccatttcatggttgcaaatttattttatgttttctacctgtacatttgggtgaattcccctcttcttgaggtcctcccagtatcctgaggttcctgtctttccagcaagtggtcttaaccatctggaagatgggagagttttgttgctgttggctgcatgtgcaccgccatctttgacccttcagagtagtttgtcatgctttattgaatgagcattgttctcagatgacacgcaggtaaggcactggttgtacggtttgtccaattctatcacgttaaaaaggaggaaaggttcttattgaacctactgctgtgaaaattaaggagactcagtaagagtttctgaattctgggataccagtgaaggtcaaagatcatttgaaaatatttcgtttttatcaaagctgagttcaacaaattgttgtaggttaaatagcttaagaagaaaaggcaatgacttccccttgtatccagaaaatagaacataaaaccagcatccacaaataacctcagtaaaacttccctcttcagttcatttagttctgtgtaattaattcttatcctgttagatctagggtttataaactcatgaaaccattgcttcttgcctaaagtgaatttggaaatgtggacttaacctcctggtgtgtttgaaagtggtgtaagggttgctcttgcctccagagcctgtccccacaggtgtcagtcatggcgatgtcggctgcagtccttctccagagccactgagactgcccttcttgttgaagatgcaaactctggcctgtgagtttatcccgagctttcaggcaggcgtttacagagtcgagcagaaacttttcacagatgacaaagacttgatggcaatggttaatttcttactgataatttttaagtgtgaaatgcctgatgaggttttatataattttcaaacatgaaatgtctgatgtggttttaatagtaatgcaactaatgaggaaattgggttgtttctgtggcatccaaaacaaagataaaaaggcgattaaaaaattagacaaaatattactaaggataataattcagcctgtttcaaagaagtcagtggatgttaacatctgattcattgaaatgggtgaacataatttttatgaagaaaacagtcttgagatgtacaatgttgagacaaaatattcccggaatataccaaagcatatcaaatgaagagactgggtaagtctgagatagagtgaaccatttttaatttcataaaacctcatgaatacatctgctgtacatgaatgcatagcactaggccacttgagaaccagtggcctagaaagtgccagattcaaattaaagaagtaatgtggctaatcattttaggtcattgaaattgtggctgtaacactatgttgttactgcctgatatcagggagagcacttgaaggactcggatacagaaaaacttgaccagactatttcataagcattttggtctgtgtttctcctgacattaaaacatattatggaatgtgaaggcattgacagatctccagggatttccactgaagcgcaccatttctgaaatacgtcttttaataacatattagcgattcacagttcacctggagaaggctgggtgtctcttctgatttcacaaccctggccacacagctcaccaagcaaacagttattactagcgtatgttttttagaggagctcttgcctatcttttgataaatttaatcctaagaattttgtattattgatgataatttgagtagaattttgaagactgtcacctttccaatatttgctgttattgtatagacacagtatagtttactatgttgacagtgtcctgtgactttgctggattctcgtgtatagagacagtatagtttactatgttgacagtgtcctgtgactttgctggattctcgtgtatagagacagtatagttttagtgttttgacagtgtcctgtgactttgctgaattcagtcttagtgccagtaaatttttttttttaagattccttaggctttttttgtataaaaatagtgctatttgcaaataaagacaatgttactccttcctcttgagctttataccttttgtttcttttttatcacattattacattggccgggacctctggtacgacgtgaaatagcagtggtggtagcagatagcttgttcttatttttgatctgggggaaaatgttcaatatttcactcttttatttatttatttttttcctggagacggagtctcactcttcacccagtctggagtgcagtggtggaatctcggttcactgaaacctctgcctcccaggttccagtgattttcctgcctcggcttccgtagtagctgggattacaggcatgtgccaccatgcccagctaatttttgtattttcagtagtgacgaggttttggcatgttggccaggctggtcttgaactcccaatctcaagtgatccactcaccttggcctcccaaagtgctgagattacaggtgtgagccaccgcacccagactcatccttagactcgtatttaattaaagaaaatgtacaatgcagacaggatggctgatgatagtccttttttcctgcctgattttggttatttgtgctttttctcttctctcttaatatcttcagatgtctgcaactttattagccttttaaagtaactgatttttgacttggttgatttctcaccgttgtagtttttccatctgtttttaatctttatttcctgtctttgggtttattttgcatgcttacaaaacttcctgggtgattgtgtgggatggcctggacggaagggaccagggcttcaggaggaggatgagccccaccctttctgtggtgggaatgcctgagctctgttgggctgcacatggctcctactttggcagtcattcaacaagcctgaggaatgtggcttactggtaaaatagaaaagtatgttgccagagtttttctaggaccagtttgggggatggagaggatggtagattgaatacatacacctacctttttctttctgaaacctcatactgcagtgagaagtgtggtgggttttttttttttttttttttttttggcaaaggttcatgtgaataaggagaaagtaaagtcatagcattcctatttcagaagctggaatgtaattggagagttggtgatggacttagctgacttgagaaaaccaaatgctaatttgggagtggggaaagctgagagctagcttgatctgtgctgcagagttttgaccacgcttgggagctgtgactgcttacttccagagtggccacacgaggacataagagtgtgttgtgagccggctgctcagaggccctggtccttgctcagcccagtgcagccggggcgggcattaggcgtgctgagcaggcggtaaagccgatggtcgtgcacttggcgcttttcgggacggggtgccttatggactacggtaagtgaactctgtgtgaccgccgagatgaccagctttgtccccactcagcattgagtctgggctggtggagcgttgtccactaagcaagagtagaagggcctcctgtggggactgagactatccagagggaggacagaaaggtactgaagtcgccacctcacaactctgttgccgtgaaacttacaggtggccgtcacagtcgctcattcagagcctcctagacatctgaaggagtctctgatgtaaaaggtatagaccaagcaaacagaaaaacagtgtagaggaaatggaaattatgcaaggataaaacttccaggaagaaacctctcataagcatcctcagtgagataaaagtggttattttaacaagagaagataatgaaacaagaaaaatgtcctctggaagaagcacattcagtgaacaagaagagttctgggaagttaaaactacatgaacagatatggggaaaaaatcagtgtaagtgttggaaaagttaaggagatccggaaagaaaaaaaagatcaaacaggagaaacggaatacactctgaggatcgggttctgtggaccacattcaacaagtaccgcaaagaaacggcggggaggacagcataatgaaacaattgaaaaaccctctcttgagcgtcatcctcttctagactgaaggagccaccaagtacccagtccagtggatgaacgtctgtgatcaaagaccattgccatggcatgttgctggaccccaaatatcagggtaaagacagcatcctacacaccttcagaaggatgagaataggttacatacgaagcgggaatcaggatggctttgtgcttctagacagcagcattggaatttagtgcacagtaaagcaatgtggtctagagttgcaggaaaataattttcagcctttgattctatacccagtgaaactaacagtcgcatgagagagcagactaaaggcacaatggagatttgcaaagtctttaaaaaagtcagtcatcctggccaggcatggtgcttcatacctgtaatcccagcactttcagtggctgaggtgggaggatcacttgagcgcaggagttggagaccattatgggtaatggtataggagagtgagaccccatctgtccaacaacagcaacaatagcagcagcagctgggtgtgctggcctgcttgtagtcctaggtactcagggtacggagggctgaggcaggaggatcgcttgagcccacgaggtggaggccacagtgagctatgaccataccactgcaccccagcctgggtggcagagtgagaccctatcttaaaaacaaattatctccctcaaatcttttttcagaaagctactggagggtgcattgtactaaggaagagagagactgatgactgaggaaggattggaacgcagggagcaggatatccgtcactgggggagaagcagctgaagatgatgcctgtgcccgggcagatggtgctcagtcctcagagcaggaagtggtgccgagaaagtctccccaaagacgagattgccaggcagcccgatgccgggtgagcatggacatctccagaggagatttgaacagtttaaagagccagggtggaatgagcgataaacagacagctaagcaagtgaaaaaccccttctcctgttagcttgaggggaagcacaaagtaggaaggagttggaagtcaccatggtttcctttgtggcctcagtgtgagtggttgagcacccagctgtgctcagctagacgcggggctcagccagacgcggggcagctagagctgtggtgatggtggtacctgcggggcggcagaggggtggtgggagcaaagagccatggcctcctcttccatcctgagaagtcacaggtaatgccccaaactgaagaattaggaaagtggcaatgaaagcctatcgtctagaggaagggaggtccgtttcaacataattgactcaaataacttagagtgtttgcttctgaggctgggaactgggccaggagatgcagagtggagttggggatggctgcttgccataacaagccttgtagtttgactatgtacactttgtttatgtaacttcacgaggaatacgtatacatggaagaaaaggagattcgactgggaatgccaggggcatgctagcaggtgctgtagtctcagccagaggcatgtgtgcagggtgcctggcaccgtctggggtcttctgtgcgcacagaccgcggtgtgcacgctcccaggagccatctgatggggcagcctcgagcacctctgacttctgacttcgccccacgggagcccatctggggctccagccttgacctggcagccagcagggctgggatgggactgcggccagccacgtgggttctcagctggttagggcctcggtcctctatcccttacctctgtcccacggagacccgtgcgagggcccatcaggcactcgagctggcaccacgaggactactgacggctttgctggatgctgctgggaagttgagccggccaaggtggcgagtggctgcgcctgggctgccccgtcctggcggcggcgccctcccgttttctgttctgggaagcacacggtgcaggcagtgtttgtgccttttcccagaggagccctttgtcctgaggaggcgtggatgttctctggagacccggggcctttcgcagcggcaccgtgacttcctgctgctgggccctgggccctgtgtggagtcgaggcctgcaggggcgagagtcagacgagagttggagtctggggttcacatgggattctgcagcttcccagcggtgtaatcttgggccagacatgtcccacccgagcctcgtgtgcttgtctgttgaatgggaagggtcgtggtgtctcgcaaggctgtgaagaatgaaagctgtgtggtgaggaataatggcagagaacactcaccaggccctttccaggtgctgctccaagcacttcctgggccttcactccagcagtcctccctgccaccctttgaggtgggggcactgttgtcatactcattttatgagtgaggaagtacaggcaggagaggttagcagctgtcctgaggactcacagccgatgagtggctgggatctgaacccacacagcagtgttgcattgccgtgtgctcttcccatcagacttaggcctcgtggtgatgagcttgtgtgtctatcccagggaccctccagatgtggctgatttctggcatctcttacgggtctggtcttgggctgcgtggtctcatggcccctttggcagcctgcatggtgccctcttactgggcacggtgaggcctcaggaacacagcagctccaccctccaactgctgggcttctctgctgccctttgcatggcggaggtgacccatatgtgtcccatctccaccctccagctgctggacttttctgctgtactttgcatggcggaggtgactatacgtgtcccatctccaccctccagctgctgggcttctctgctgtcctttgcctggtggaggtgacccatacgtggcccatctccaccctccagctgctgggcttctctgctgtccttctctgctgtcctttgcacggtggaggtgacccatacgtgtcccatctccaccctccggctgctgtccttctctgctgtcctttgcagggtggaggtgacccatacgtggccctgctgtaatccgccaagcacttccgggggtgaggttgaggaatctttgtggggcatgtgtgcacgtgtgtgcatgctgtggctccagcaccacagtgttgacagtcctgtgagcctactgggtaagagcctaggttgaggcctgctgcctcctttggttgtgtggcctcaggcaggttatggaactgcacccatgttttcatctttaaattggggagaatgagagtgcccttcgctctgctggcacgatacgcaggaaacgttgcttctcttcagcagattattaggattctctgaaagttctccccagttctcttttctaccccattcattaatggcagccaccagtggcgtagcagcaaggaaaattgggccgttttgaagcactatcgagttctgcctgtcttgctaaatcatctgtgttccaactgtgctctttgaactgttgaaggccagaagttgttttgcgtttgatcacctataaccgccaaccccccatgtgtttctgcctgtgtttaactggtcacagggagcttggggctcctccggttcccatccttgggagaggcaggcccatccactcagtacccacggcaggcacctggttctcatctctgacgccccgactttcccttctcagcctgtgtcgcctttcctgtgatttcctctccttgccttcctgggatcctgctagttccagcccatccccactgccgctacgccacttggaaaccctttctcgtgcagtggccaccttaccgtccctggcttcacttttgcgtcttgcaactattcttcactccagcacttggagggatctgcctgagatgaagcaatgaccacgagaccctgctcaaagctgtttgtctgtccctgccgatgtcacgatgaagtcctcatgtctccatgtggctgaccagaagcctcctgccattgcctggctctcccgcttctctgtcaccctcgcctcagcctctgcaccagccacaccgaacatgagttctgtgctttctcccactccctctgccctcccacttgccctcccctttccctgttacggcccactccagccccgaacacttagtggctttgaacagtgcttggtaatttttcaggattctgcaggttgcctggggccaatctggtggcagttggggatgggacatccaggatggctttatgtgcacgtgtgctgccttgttaatggccaggaggcagggctgccttctttcctcaggggctctctctggctaggacgagctgcttcacgtggctgccaaagcccatagggacaagccctggcatgcaggttccttaagcctgttggttgtggttgcagtagctgtggccagagcctggcccgggtgtttgtggaagggacgacctgagggcacgagtccgggaggcagggccccttcggatgcattcatcatttagggtttatctgcatcctgtctcgtctcaggaagccttccgcaacccctccacccagactgtggtccagcccctgctccaagtgcccccggtgggcctttgtgctctcagtcctggccgacccctccacccagactgtggtccagcccctgctccgagtgcccccagtgggcctttgtgctctcagtcctggccgacccctccacccagactgtggtccagcccctgctccgagtgcccccagtgggcctttgtgctctcagtcctggccgacccctccacccagactgtggtccagcctctgctccatgtgccccctgtgggtctttgtgatctcagtcctggcaccttgacccgctgcttgttctgctctcctttaaactccatgcacctgacctgttaattgcacgcagcgcggagcctggcacctgcagtgtagacacactggccaccgctcagtgcaagagggcccctttgctaatgtgcacagctctttatgccttttttcctatgcctttttggattggagcaagagattttttttttccaagtaaagaacaatttatgttcctaaatactttttttccttgacatgacgaagttgagcaaggtggctatagaactttttttcttaattttattgcacaagtaatgttctttacaaagtagggaaatacagatacataaaaagaagactgccaatcccccgtaatcccaccagtcgcatccctacccgctcttaggagattccggtttacctttgtagattttcactgtctacatgcggactttaaaaggtgcagtcctgcaggcgaatgtgtagccgcctgcgtttgcgtcataggtcccgaatgtcctttctgccacacaggaggccatcccacgcttgtcctgtcacggatcgtttgcctcctgtgaatattcaggttgtttccggttcttcctgttctgaacagcgccaggacaagcaccgggtacacatttttgcattttaaaacacatttagtaactcattcttcagctggggaaaagcccacgtaagagcccatcagcaagtccgagcgcgtgttcctcccgcttcagccgccatccctggctccttagcgtgttcctcccgcttcagccacaatccctggctccttagcacactcggaataaaacctgagtcctcccggtggcctctgggccccacgccccgtgtgtctgccccctgctccaggcttgtgttcttcctccaccctcccagagctccttggtgttccggcctcaggaccttgacctcgtggcgccctccacgcgggagtatcgtcctgtgccttctcgcggctggttcacccacaccagccacatcatcagaaggaagagattcttaggcgatttttgtttgctgaaggagaatcacagatcaggatgaggtctcctggtcccttcctcccttttaaggacagataactgaagttcaggaaagcccaggccacacagcaggccagggaccagctggggccacagcccaggcctgcaggtgcatggctgttgcctttctagagttctgaggccttttctctccctttattgctcagcaagttcaaagaacatctcgctaatgatgcacctttttctgagtttctgttcgttaaagtcctttgttcccacattgcctttgattgtttctctagaagccagatttacttgattttcaattcactgttctttttttttctttttttagacagtctcgctctgtcacccaggttggagtgcagtggcacgatctcggctcactgcaacctctgcctcctgggttcaagccattctcctgcctcagcctcccgagtagctgggactacaggcacccaccaccacgcctggctaatttttgtatttttagtagagatggggtttcgccatgttggccaggctgttcttgaactcctgacctcaagtgatccacccgcctcggcctcccaaagtgctgggattacaggcgtgagccaccatgcccgtccaatttactgttctttactctgcaatctgctgcctctttgccaaaataaatctttgcaggtaagataggtgcggtggggagtgtgaaatttattacagaatggttattttgcttcttaaaaaatttttgttttaagaggcagagtcttgccatgttgccctggctggtatcaaactcctggcttacacgatcctcctgccttggcctcccaaagtgctgggattacaggcatacaccatcatgcctggtctaaaatattgtgtttttttttttaatttttttaagagatgaggttgcccaggttggagtgcagtgatgtgatcatagctcactactgcctcgaactcccgggctcaagtggtcctcccacctcagcctcctgagtagctggattacaggtgcccaccaccatgcacggctaattttaattattattattattattattattttttgagacggagtctcgctctgttgcccaggctggagtgcagtggcgtgatctcggctcactgcaagctccgcctcccgggttcacgccattctcctgcctcagcctcccgagtagctgggactacaggcgcccgccaccatgcccggctaattttttttgtatttttagtagagacggggtttcaccgtgttagccaggatggtctctatctcctgagctcgtgatccgcccgcctcagcctcccaaagtgctgggattacaggcatgagctgccgcgcccggcctgctaatcatgactaaaggtagaacagtcaggaatgtcacctgttatctctgaagtcatagtcccttggttttccctgacctgcctgctactgcgcccacttgcagcagcacctccgttgcccagtgaagcatgctgccctggtcttactgtttcaccggcactctcctatctgcgatgccactgtccacagcggggttgctttagggtttcgagctcacctggggccttcctgggttctagccccgtgagctacaggcacttctttgtaaaaggggattccaccagttaggcagattccggttcagtctccagcagcccggggcccttcctggaagagtgctttgtgagcggagtgcgccgcccaggtgtgtagtggtgcttctcaggcccatgggctgcccttccctgggcctcttctgtttgaggcccttgtcactgggttcgcctggcatgatgatggaggccctgcagctccctgccaggcgtggttccgcccaggtcattctcccggcccagctgctgtggacagtggacacacgctgtcacagcctcaggccggccgggccacgcctcccggaagcgggcctgcttgtgtgtggttgcatcccaagctctccacttgctgcccctgttctgagcttcttgccgaagttgtgtttggggccattatctagctttctttttgaacgtttaaagcattcaaaagatcagcttttccaaagagtgaggaaacagggagagaaaattatggcatttgtttgaaaggttctgagggcttttttttagcttgaacagttcaaacagcgcctcttgttaatcaggaatgttctggcatccctggggtggtcacacgggcttaattggaacccaggctgctttgaagcccttgagatccttcctgagctgggagaaagagtgcgagggcagcaactgtaaagccggcatttcttcattttatttacatgtgtctggggacccttgtaactcatgtccctgcagcagttgagccaagttgctgacttgtggacagctcagagagatgggggccagtttctggcaaaagagctgtaaaacatggcctgggtccagggctgcggcgggatcccctcctgggaggcgaggtctggatggaccacgtcacagtcgtggtggcgtggactttgctgctggcggcctgttcttgtcagaagtttccacatgggagaacgtgtggttttactgaagtcacttaatgagtgaccctaatagctctaagacgttcatcagtatggaccccaggacttacttcctctttcgcagagcatgtggacccacagtaaccacactggagttccaggcacaggtgtaccctgggggccggtcattctgcgtacacagacctgcctttgtcagcggggctgtgggcagcatggggtggccatccagccatggccatgttgctccaagccccaccgtggtcctcaggggcactctgtctcgccctgagcctccagccaccttgcccgtcagtctttccctgtacctcttggggatggggagtctgccacctagcaaagcacccacttgtcccaccccttccattctgttgagctgagacgcgtgttttggtcgtttcgtgccgtggacaccaccttggtttagtgaaacacggcgcagagtcccctctcccctggaccacgtttccccatttcagctccctgctgtgcacggctgcttcttcccgctctgcagagggtggtcctggtggctggagtgcggcaggcagcagcatcctcccatggtggctcgcatcccagagtgtgaccgtgggttcatgctgacggctcaggcatcccctgagcctggacactgaagtgtacagattgaggtgtgttgttggatgagtcatgacaagtggaacatgtgcactcgtccagataacacacttctatcagtccagagttcccggggtccccccagtccagcccttcatccccggcagctgtagcttagccttgtttgttgtagaacttcctataaattcttccctttctattttttttctttttctttttttttttgagatggagtctcactttgtcgcccaggctggagtgcaatggtgcgatctcggctcactgcaacctccacctcccgggttgaggcgattctcctgcctcaacctccagaatagctgggatgacaggcgtgagccactgcgcccagccgtatttgtattgcccaccttttgtttcgttgaatctgtgctcaggtgtcacctttccctagctagagccctttcctggccctcccgggtcaacatgcccccttccctcagcctcaggctttccactcttctccagatccggccactggatcaagccactgtcacctcctctgggccttggggatgtcacctgcccactcttgtcatggtcggcctcctcagcgagccactcagctctagctgccaaggactctgtctgtttgtccatgtagtgtccttgctgggcacacagtaggtgctcagttaaatttgttcactggatgcagattctgcaggcatcttcacagattatgctgatggagcaggtgtgccctaccaccatatgtttctacaattgatttttttttggtgcaactgtcaaaaaatttatttttcctctaccacccgcaacccccccccccccatttttcctgcttcttagtgtggttttagactctgattctgtcacttaacatatctgctgtctccatttgatgtgacctacaacctgataggcatgccgtctgcccctgctcgggcgatgggcgtgggcaccagcaaccgtcacaggggtccagggttttccactgactgccgggtgccctcagcgcagagctcctgcaggagggtcgaattgtctgtttcatagaccagaaaactgaggctcagctgggcccttcacctggctgcctccagagtgcgggctttctgctgtgccaggctgttctcttgcctctcccattcctttgcatcagtcggcactctggaacagtgcctgaggatgttagaatcaccttatgtctcctctggaaagaggccagtggatagagaaatatttatttctgatcttgtagtctctgtttatacagcggttcgttatacaagtaacctattgagaagaggacataggtgtctgcatgcatccgcttctcagtgagtccatgctggactgtaactgttcccattttcctgaggtggggggttgaggtttggagagctcagagtcacagattcgcaatgaatggacttagaattgagtgcttgactgactgcagacactaaggtgttaactctgctgcctctttatgcttgggatggtttgcagaacctgctttttgaaaacaagactatttacatgcacgtttctgttcccagtaattcttggcatggatgagggagatgctttgtgtcagattcgcatggtgaggagggggcagctctgagaggagccaggcccaggctgcctccagggcgtccagtgctccccaggcttgcctaggagagtgtcgattcctgctgcacagcaactctcatgaccaagtttaaaatgcattatacgtagaaaagtgtgcttctgtggctcacgcctgtaatctcagcactttgggaggccaaggcgggcggatcatgaggtcaggagttggagaccagcctggccaacatagtgaaaccctgtctctactaaagatacaaaaaattagccaggtgtggtgtcatgcgcctgtaatcccagctactctggaggctgaggcagaagaatcgcttgaaccgggggggcagaggttgcagtgagccgagattgtgccactgcactccagcctgggcgacagagtgagactctgtctcaaaaaacaaaaaacaaagaatacatactgtcgcctgtgtgcccattctcaagaaaaaggaaagtttctttgaaaacatgtggaccttccctagttccatcccattacgcccccaacccacactcccagagcaagcccctgggctctgtgatcactcctgagttttgtaaacactgtggtgctcactcagtcctgctccctggaggccttggccgcccatccttaatgtgccggtttgtgcctgttgcacgtcattgtaattacatcatttaattaaatatggaagctgatgaaaaataattatgtgtagagcaatgtttctgtgaagacaaagctgaatgctttggaaagtcccaaaggaaaattgctaaaaaattgctattgaataaagcaaatagtgaaagattatgaggaaaagttgtaaggtctgggaagatgacagggatccactttaaagaaacaaagctaacaatcatgagcggtgtgtcgtggacatggttcatgcaaaaaaaaaaaaaaagatgaaactccaattaatggactcatgttcgaagaaaaagtttgcagcttgaaagataattgtgtgtttttctgttttaagttgaaatgtttgagatacacgcatcatttgattcctcacttagccaacttctgggatccattacgtttttttttttttttttttgtgagtggtggattatagataactttatttttattctttgtgttttcctcttttaatggattttttttaagatatcatttacccctttaagttggttttttgtttgtttttttttttagtatttattgatcattcttgggtgtttctcggagagggggatttggcagggtcataggacaatagtggagggaaggtcagcagataaacacgtgaacaaaggtctctggttttcctaggcagaggtccctgcggccttccgcagtgtttgtgtccctgggtacttgagattagggagtggtgatgactcttaaccagcatgctgccttcaagcatctgtttaacaaagcacatcctgcaccgcccttaatccatttaaccctgagtggacacagcacatgtttcagagagcacagggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaaccgccatcctcatcatggcccgttctcaatgagctgttggatacacctcccagacggggtggtggccgggcagaggggctcctcacttcccagacggggcggccgggtggatgggcaggggccgccccccacctcccggatgggcgggggccgccccccacctcccggacggggtggctggccgggtgggggctgccccccacctcccggacgggctggctggcgggcgggggctgccccccacctcccggacagggcggctgctgggcagaggggctcctcacttcccagacagggcggccggtcagagatgctcctcacctcccagacggggtggcggtggggcagaggcactcctcagttcccagatggggtcgcggccaggcagaggcgctcttcacatcccagacggggcggcggggcagaggcgctccccacatcccagacgatgggcggccgggcagagacgctcctcacttcctagacgggatgtcggccgggaagaggcgctcctcacttcccagactgggcggtcgggcagaggggctcctcacatcccacacgatgggcggccggtcagagacgctcctcacttcctagatggggtggcggctgggcagaggctgcaatctcggcactttgggaggccaagtcaggcggctgggaggtgaaggttgtagcgagccgagatcacgccactgcactccaggctgggcaacactgagcactgagtgagtgagactccgtctgcaatcccggcaccgcgggaggccgaggctggcagatcactcgcggtcaggagctgagaccagcctggccagcacagcgaaaccccgtctccaccaaaaaatacgaaaaccagtcaggcttggcggcgcgcgcctgcaatctcaggcactcagcaggctgaggcaggagaatcaggcagggaggttgcagtgagtcgagatggcggcagtacagtccagcctcggctcggcatcagagggagaccgtgcaaaggggagagggagggggagggggaaggggagagggagggggagggggaaggggagagggaggggaaggggagagggagggggagggccagggggagggccagggggaggggcaggggctccattatcgtcttgatgattctgggtaggaaaccttgcagtgatatattgctgccccatttatagtgccagttatttgcattgttatgcatagctgagcgtcagttaggaatgatagaattgttttgttacaaatgtttataattagattttctctgcattaatttgttgtgggaattatttttctttttataaaatttttatgtagtacctgattctgcaatataaggttgcaatactaggctttgaaaattacttattgaacagctattgtattttcttggtacagaatattgaaaacattcaaaaagtatccagtggctagcccggcatggtagtgggtacctgtaatcccagctactctggaggctgaggcaggagagcggagattccagtgagctgaggtcatgtcactgcactccagcctgggcgacagagcgagcctctgtctcaaaaaagaaaaaaaaataggccgggggcggtggctcacgcctgtaatcccagcactttgggaggccgaagcgggcagatcacaaggtcaggagatcgagaccatcctggctaacacagtgaaaccccgtctttactaaaagtacagaaaaattagctgggcatggtggtgggcgcctgtagtcccagcccctcgggagtctgaggcaggagaatggtgtgaacccaggaggcggagctttcagtgagccaagattgcgccactgcactccagcctgggccacagagtgagactctgtctcaaaaaaaaaaaaaaaaaaaaataggatccagtggcaagcctcctgccatgttcttgttctccagcaggaggccattgttattttcttgtttatcttttagattttttttttttttttgagacagggtatcattctgtctgtcacccaggctggagtgccgtgcgcgatcatagctcactgtagcctctgcctcccaggctcaagagatcctcccgcctcagcatcctgagtagctgggactataggcactccccaccaggcctggctaattttttgtattttttttgcagagacggggttttaccatgttgcctaggctggtctgaaattcctgggctcaagtgatctacccacctctgcctcccaaagtgctgggattacaggcatgagccactgcgcctggccagacttcttttgtgcaaaaatgaatcaacacagccatgcaggttttgacttttctgcacacggcagcatagcatacttatagtccgcttcttgtgtctgtatttagcactgcctttttggtgatctttcatgttaatataggaaaagatgtgtttttttcctcttacacaagttccattgtatggatagactacgacatttaacctgttataccgaacttttaatccagtggtctgagttcagtagaatgacttgcgtagcatttagtcggatagttactgttctggaatgatatgattttttttgctcattctcttagtatttattgaaaacgtattattgggccagtggaaaaaaacagaacaaaataaaaaacagtcccatgcctttctggagcctgcattccagtggagggggaaagacactaaataagcaggtagaaagatgcaggatctcagctggtggtgttctgtgaaggaggagagcaccaggaggagcggccaggagccagggctcaggtgacattccattgaagactcaaacaagtgaagagggggcaggccacgcaggcatctaggggtgcggtgttgtggaagagggctgtgcagaggacctgaggtgggaatgtggctcccgttgtgggaggttttgaggcagtgacgtggagaagcagatgcctcctgcacccctgtcctgcacaggcagtgtgtgggacccacatccccgtaggaaagtggttgctccctgtgggagtcacagcgtgacgagggtttgctgctgcgtgggcctttgggcttatggatggggctggagagtagtggtggagcagccaggcctgaaaccacaccttgcctgggtccctttccatggggtaagagtgacctttcctctgtctgctgggaagagtgtgagtggcatcgtctgccatgtggccagggtgtcacggagcggcccaggctcttggtgagagggactggtgccccatgtgaatcccctgacttggggttcctctgatcttgggaccagagagtctgagctccagcttagtggcctcaggctgggtgcagcaggtgcagcaggtgcagcctcaggcaggtggctcctgcagaacctgacccagggccgggtactgcacagcatggcattagtcccctgtcttcaggaaaacaccagctgctcctcccgtgttctggggccatgcatctctcccaacctggcgaccccacctttccacacaattgtgttgcatcagccagaaaagtccggctgacatgacgccctgttgcccttgtgactttgcagttgtgaatgctgattgtcctttggtttgtagcactgaggttttgctgtctaatgtattttattcctatttctgcatacttttcgcaaaacaagccctgcagagacagcctgtgtcgcttgggttgtgttccctgccttccgcagggctctggctggagccccagcctcagcagttttggactgtggtcctaggccctgtggatttctattctttgaaagcttgaggtgtcttgtttgctaattagtttgatggctgttgctgtttcattcattttccacctcggagtcctctgggtctccagtttttcagactcggtgaaactggcactttgggcttcagctagagccccaacatctgctattagccccaaaatagctgtggcttgggctggagctgctctcgcctcggaaggaaagcagtaggccggactccccacagccctctgctgctctgcgtgcagctgggcttgagtcaaaattcagctgcagatagaacaaaaagactttcttccccttgaaaacccaccagttagaatttaaaaggcttcgcagctgaagcccgcgtgttcagcagcagatgtcacagcttggactgcagttggaactgtcactgccgtgtcatctccgagctgaggctcctgaggcctctgaatgccttccactttgtagttggtgaagtgcgggtttcagaatggactgtcgggagttattcttaggccgtaataatacttggcacggctcctcctggttacgagcacttagctaatccccagagcacccttggtaaacatctctgagtagctttaaccacacacaggtcaggaggcttctggaaaataaacactcttcctgccagttggaggtgttggggctctggtcttggatttgatgtgtggcgaaggctgcaattgtttaataacccttcatgattcaacagctcttcaagaactttcctctgttcttgtgtggagctcgtgacagccagtggtggtggagctccagccctctcttcccacaggcacaagccgggttcctgagtcccagggcttctcgggaggtgtctgccctcctctttcagacaccctctgccctgtgtcccagggccctgggcctgtgctgcactgagcagagactgtaggggaccggctctcccactcctcccagatgggcagcgtcttccgtgtcgggagcatgctgtgctgcttttctcttctcagtctcttagtttttgcgggttcttacgcatgtgaggtgtggacttgcatggtggggagctcaaatggtaacatgaaggggaggagccctctgagtgctgtgatttgttccatcattaccgcttcctgatcacggtgacctgcactgctggagtggtcagtggagccaggcctccccacaacagtgttcccatcgccttcttactattgatttctattcttaaaatattgtattacttagcactcttttgaagacgttccagtatatatcaaatgatcaaaagtccataaccttgtcctacgtagaagccaaaggtgtcatgcagtttcaggtgttcgagtttccagaattcttgtgatgacatttgtaggattcttcttttagacttggaccaaattctgtaacctaatatttgtccttcagattgacagagaaccgcaggcagtgttttctctgtcacacgtgtggtgggtggcatcctggtgacataaagaattgcctttggtaacttgcccagaaggctgtagggttattttctgcttagactttcccctatttctttcttttcttttcttttccttttctttctttctttttttttttttttgagatggagtcttgctcttgttgcgcaggctggagggcaataccgtggtctcagctcactgtaacctccacctcccgggttcaagcaattctcctgcctcagcctcctgagtaggtgggattacaggcacctgccactgcacccggctaattttttgtatttttagtagagacggggtttcaccatgttggccaggctggtcttgagctcctgacctcaggtgatccgcctgcctcggcctcccaaagtgctggcattataggcgtgagccactgcgcgcccagcctcccctctctatttatgcagatgatcggtagttccggaagtagttgtgtgtaagaatcaccagggagtttgtgtgcagcccctaagccccgccttcaggggggtcttgattcagtggggtggggtggggcggggcaggctggagttgcctcagatgactctggtgcaggtggtccatgccattagcccgacgtcatgacgccacgcaccgtgaaaccatgcatccactgccctcgccacacgcgccgtgaaaccatgcgcccgctcccctcgccacacgcgccgtgaaaccatgcgcccgctcccctcgccacacgcgccgtgaaaccgtgcgcccgctcccctcgccacacgcgccgtgaaaccgtgcgcccgctcccctcgccacacccgccgtgaaaccgtgcgcccgctgccctcgccacacgcgccgtgaaaccatgcgcccactgtcctggttagagccgagcacatcctcgtgtcctgcgctttttgcagcaactgcctgaccacctttttgcccagcatcagctttaatgggtgttcagtgctcaatgttatggctatgaggacttgcttattttttttattgttgagcttttttttaaattaaaaactatgagatggagaaagtaagttggtgcagccacagtggaaaacagcctgtggtggttctcggaaaaaccgaaaaggggatgctctgtcagtgccgcttctgcgtatccacccgagatcattaaaagcagcgtttggaacaggcattggcacacccatgttcctagcagcattattcacaacagccaaaaggtgaaagcagcccaggtgtccaccgacgggtgagtggataaacgttgtgtagccacacaatggagtattactcagccttcaaaaggaaggagagtctgccacatgctgtaacatggatgagccttgaggacgtgatgccaagtagagtgagcccgtcacagagaaatgctctatggctccactcatgtggctggagtggtcgcattcttagagacggaaggtagtatggaggtggctggggctgggagcagaggggctgtgggagttcctctttaatgcgacagggtttcagttttgcaaaattaagagttctggggataggtgtggtgctggttgcccaataacatgaatatgctcaacacgacagaactggggacttaaaaatggttaagatggtatattttatgttaagtgtattttaccacaattaaaaacatcccaacacggtggcaggatgccaccgtggccaggtgtggtgcttgtcttgggtttcctcaggatgtcctcttggaagagcgtggcaggtcagcaggtcaggcctgaggacccccctttgctcgctctcttagcctcgtccttttggagggtccagtcttcctcaggtagcaagccttcttgccaggccacagaagccccaagccggaggagcggctctccggctcccgtgctgcttctccgtgcaagcctctctgagagctcacagtccacccctgtggactcctccgcgtgcccagagcctcctgggctcctcctccccaccccgcttggttcaagggtatgtcctttactccagatggtggcctccgtccttctccacaggctgctgttaatacgagaagagggcgccggaatgcttcctgtagagttcaggaggtgacctcctgacccgtttgatcggattccaccttgttcttgatgggacctcctttgtggcctcagaaatgtccacatgttggcaaaaccatttcatcttttctttttctgatatggagtgctctgaaaccattgccttaaacccattctgtttccactagctaaagctcatacacttcatccccagagagcccattttcttttatttatttatttaccatttatttatttttatacataatattttacatatttatggagtacctgtgatattttcttacgtgcacagaatgtggaatgggcaagtttagggtatttggggtaaccatcactttgagtatttatcatttccacgtattgggaaaaattctggttctcttctagctactttgaattatacaatacactgttaactctagtcaccctcctcttctgtggaacaactgaatttatacctttcatctaactgtatgttcgtacccattaactcaactctcttcatctgtggttccgctcacccagacctttcaatccactagttcctgtcattctactctctgcctttaggaggtgaatttccacagctcccatgagtgaagacgtgcagtttctttctgttcctggtggtttcacctgacacggtcacctcccattccagccacgttgttacaaatgacaggctctcattctttctttttttttgagatggagtcttgctctgttgccaggctggagtgcagtggcgtcatcttggctcactacaacctctgactccctggttcaagtgattctcctgcctcagcctcctgagtagctgggattacaggcgtgtgccaccacgcctggctaatttttgtatttttagtagagatggagtttcaccatgttggccgggctggtctcgaactcctgacctcctgatccacctgcctcggcctcccaaagcggtgggattacaggcgtgagccaccgcgctcggcccagctcttgttctttcttacggccggatagcattccactgtgtgtacatccccattttctttatccattcgtctgtcgatagacacaggttaattccgtatctttgccatctttgctgtgataaacatgggaatgcaggtatctttttgatacagtgatttcctttgagtaaatacccagtggtgggattgctggatcatgtggtggtgttctgttttcagctttttgagaaatctccatactgggttccatagcggtggtactaatttacattccttccaacagcagctgagagttccctttcctctgcatcctcaccagcatctgtctgtgtgttttttggtctgtttattagccattttaagctgaggtaaggtggtatctcattgtggttttgatttgcaattcccccgatgattagtgatgttgaccattttttcatatacctgttggccatttgcatgtcatcctttgagaaatgtctctttgtgtcctttgcctactttttcgtgggattatttatgtttttttaattgttgttatttgagtttcttttgagttgtattttggatgttagtcccttattggccgaagagttgacagatattttcctgcattcaagaggctgtctcttcactctgttgattgttttcttggatgggcagaagctttttactttgatgtagtcccatttgtctatttttgtttttgttgcctgtgcttttgaggtcttagctataaaatctttgcctagaccaatgtcctgaagtgttttccttgttttctttagtattttttatatttttgggtcttaggtttcagcctgtaatccatctccagttgatttttgtatatggggaacacattttcttttgattgacactgccgaacaaagggtatacaaaatttcacaacttttaacatgctggttgatgattgtacttgaagtgttttctcctcatgtccccggcgacatccagacaccgcctccacggtgcatgtcctctcccggcctcccaatgccagtgtgaaaatgggcttggattgcacaccctgaaaacagcctccagcctccctgtcccttccacatccataaagttaacggcatagggattgtcaggtaatagcagtgcactgtacctgtgccgtagggttttggaagtgagccttaggaagcccagccgagcaggtagggagttgagcctggaggggtcagggctggggctgagacccaggttttctcccatgggtccatctccttttcctttaaggatgtcctggccttccctctgtctctgcaagtagagtagactggtcccgtgtgacgttcttgaaggctgtcatcgagctcactgtgcttgtgcttttgagtggaagctgaaccctggtcatgagcaagaatggccagacagggctcgtgaggcttggtttagccaaagtggtgactgcgggtttttcagcgcaagaggctgcgaagggagggattccttctggtgcccctgtgccctccagcggcttctgcccgtgggaggtgttgggcacggctgcccctgtggttggagggctctggaatagcaagccctgcagcttcagtcctccctatgatgggggcctggtcgcatggggactgagagccggcagggatctgggggcctagggatgtggccagcaagtatccaggctgagagcccatcacgtgacagtgctcccgagggctggggtctgtgtgggaccatccgcctcaggcgccagccttctgcctcagggcaagccatgctctctgttcctgcctggggcaggacaactccaggtcacacccacctcaggcaaggaggagcgtgcaggggagccacccggaagcagcctcctgcagagtcggtgggaatgtggagagccagcctgctccttgggtgatggagatggatgccccggggctccagagtactcaggtttctcctgtggcccatcagtgccagaatgaggcgttgaccccatgacatgagacagaggccttcctgggtgacgtaggagactgcctggtgcgtgtgccatctgtgggcgcccagcacttcagaagagagctctgtcactgtcacttttcagttgatttgaaccactcccatttcccccctcattgctaaatggttgcatttatcatggtcttggcatcactgggaatcgcagaacatggttagcagagcctggccctctgagatcttaccccagctcccagctttgctgggtgggttcgtaccttggggcaagaagcttgtttctaaatcggtgtcaaatgctcctgaccctgccttctgctctgcaggctgcagggaggcttccccacagagggaggtggcaggcagtgtgccctctggtgagagagaaccatcccagctgggagaaccctggggcctggtactgcctgccaaatgcctctccactggcctcctgctgtttcaggtccagtgacatgtgaggtccctgaggggtgtgaggcggggtggtcttggctgtgtaggtggagcctgtagcctgccgcctgtgaccaccccacctgccgctggttctgggcacaggggctgggaggcgccgttgcagatgtggatatatgcgatttttatttatttgttgtaaataaattctttgcactgagttagtgaaaatttacaagcccctttgattaatgcaaaacaacttaaatatctcattcaaatgtttcagaaaaaatatctcttggcttggaaaggtttccttactttcgtactgatatttttaactccctgaggttggaagctttgggaaactggagagaatggtcacggcgttcaagggcagctgcacctttcatctctgtcctagagttcagtttctcttccaaggtctttcagtcataaatggtttttccacggagctgctttctaaccccggtttgcctgtgtgtgtgaggacagatggggtctccccggtgccagctactccttctgcacccatcgctgtccccactagatgttcagcaaggggcctgttctttgggtgggcagaggaggcctctctgggggacgtggaagggagaaggccgtggcgtgctctgtgtgaattggctgtggtcagagggagggcttatgaccggccctgggtgtgtgtgagggctcagggcctgggccaggccgcaggacatctgctcacaggctcttggtagctttgttccagtgatggaagacactccagaaacaccaaactaatgctgggcaaggcggcctccagctgtcctctgtgccgtgcaaaacaggcatgggatggcgaggggcgtgggggtggccagagacactgtaaggaagtggcccttcctctgtttggaggaggagctgggtgctggaagaccgggggaggggctgtgtgagcgctggatgagctgatgagggtttcgggggcccatgggtagggtgctcaagtgacaggaaaggtcagtggctgtctcagggcagagtctggtcgggcccagtgcgtgaggtttgcagcgtgcgcgttttaggcagcaggatggcttctgttaggggtccgtggttgcagtgtgcctctccgtggccgtggctgactcgcagagaggagctcccgggcaggctgctgggagggtgtgcccgggatccacccgaggctgctctgggggcctggctgacagagtgactgggacctctccttccaggggtgcaggtagcctccttggccaatgtcggggtccccgttgctcattcagtggtgcggtgcgggctccctgagtggggctgggtggggctctcacagcattgccagcgcctgctttctatgtggacctgcgcttggtccatgacaggtgaagagaagaacaaggatgggtcctcgggcctgagctcacatgccactgggtcagtctagccagggagccttggctttgtgccccaggttgtgaggctgggaatgctcacacaccactggcgtaactttgcatgcatggctcagatccttgctgtgtcctccggagtcccagcgttgagttagaagatgtggctcgggccgagctcagctgttgctgatcatcggggtgcactttgaactttgaagcggctgtttcacattggagtctgagtttcctcgtttaaaaaatgaaaacggtgaacaacagggttgctggggcattcactgagacaatctggaatcgtcctggaaagtagaaagcgctacacctggagatcgctgattttactcttgttgttatatgtgggtcttctgaaggagaggtgaggaaaggaacttaaaactcgctgagcacctcccctgtgccaggggcctggcgggtgctttttaaacatgatttcgtttcctctgaagagtgacactgtcaggtcgtgtctctgtttctacaggtgaagtaaaatcggggctttctaaggtcatctccccggtgttgcataggggtgggggctgtggttgaccccaggctgtagtgcgtgcatgctgccctggacctgggtccacagagttcacacatcctgggtcccagagcatcagctacagaggttgcttttggccttctgttttgtgtgcagaatcaggtttacttctcggggacagctggaactgagtgtgccttgtttatcctgcaggactccagaagacctttccagattcgtggttgagctgcagcagagggagcttgccttgaaggacaagaacagcgccgtcaccagcaggtagacctggccgcccagggtgcttgtggggatgcgtttgctttggagagttaggggtgagtgagagtgtgtgccccctggctcttgggggatggctgtccttcatcatgtggttggccctggtctgggaggagatgggggagcagggatttgagggaagggtttgccccatgtttccaccatgtgctgtgagcctccgctgaggcaccaccgtccatcgttctgacaatgtgctaaactgccatggggtctgggggttggcctcctgttgtggggtccctccttggatcaggagggttcttgtcttcccagcagggttggggcctcatgtggtcttgggaaccagcccgtcggtcactagcgggcccaccctgagtcttcacgtcagcatgaatgcaggcgtgattggaaggggctcactatgaataccaagagacatgcccctcactcaggaagtcccaagggcttcagggaacctgggatgacgatcagatatgtatttcttcttatcccacagcccggctcttctctggtttcgctcgtggctgtgaggggccatccaggctccggcatcacacccagaggcggaaatgagaggcctcttttttggatcttttctgtacaagaaagcgtttcctaggacccccactgccagcaagggccccttatgcctccttggctaagaaggggtcttatgcctgcccctgaccagaaggtggagctaccatgagggactgaaccccatccggtgggacctgtggggctggtgggcagtggggtgggcttgcggcagagggaagggccgtgcaacggggccccaggggagctctgcgccctgcacggctgaccaggccgtgggtctgtgcggagggcctgaagctcacctgtttgccattgatgatcaagctcagccttgtcctcctgtggagagagtgttttaataatttattaatagccagaaggaggtttcttattttgggggctgatgtcactttgaaaattggcttttagaagcatctggttgtgttggacataatcacatcaatttactgaaaaacctcaaatgataaagattgccttttgctttcaaagccgctgtcagatgaaacaggcattaaaagtgatttgaagttaaagcgttcacactttaccaggcgatcctcatcattttactttggaaatgaaacagaatgaactattaaaggaaaggaaagttgcctgtacttttctcccaccaaacagggaggtgcttcctaaaattatttgccttgaccagcagcagcaggcccatctctgtgtccagggccacacggaagggaacattcgcatctgcatgctgcccatgttgccttcgctgtggtcagagatgtggattgagcccatggggggattggtttgggaatggggtctctgtctcagggagcagcctctacagtgggcaggtggtcctcacaaccccagctgtggctggcctctcaggacctgtgggctccctctgagagctggggcacccgccctggggaagggtgagtcttggggcatcccatggacgcgcttggtgctccgtcctgttctgtgaaatggggtcttgggggtgagacgaggtcctcagtactgcgctggtctgggaggccaaagggagaagctgccctgaaatcctgggttctcacaagcgtttccagcttgctttcatgtgtgtgtctgtatgctggcttctgtcccacgtgtggcttattgccctgtgtgggcttctttagccaaggtgcaggctccagatggcgctggtcacccgtcgccaggagcgctggagacgcttccctgagatggggcagtggagaggcgcaggaggcctctgggcgtgaggttggagctcccggtccctcttgcctgcaggtcctggggggcggctggtctgctccttgctggtcatgtgacttgggcaggcacctggtcctctcttcatctctgtgagctgaaaggtactggcagtaacgactgggttgctgtgaggtctgagcctcctgaactgcgcctgggcactgagccgtccccgggtc

SEQ ID NO: 14462 - DNA, 4439 bp, Human
tagagacggggtttcaccatattggccaggatggtctcgcctgccttggcctcctgaagtgctgggattacaggtgtgagccactatgtctggtaaaagatgcattttcaatacgagacagaaaggtgttttggaaaaagtgcaaaatttttgcacctagtggcatagctgcattgacagcttcacgaatttccttttcttgttttacaatggtccttacgctggatttatttatcttgaattggcagacaactggagttgcagatctcaatctatggtgcatatcaagcaattcaactttttcttgtaatgttatgactttttttctgctttttgggagcatttccagcattatttactagtggcactttgtatgggtcccctggtgttattaaggtaaatggtgttacacttaagcatgatgaaccagaagaggtcactttttactgtgacacacaatttactggaaagatgaaatgttcactcagagataattagtgttacatggtgttaagcatatacttgtgacacttgagctcactgcagtagcagcaggaggtggctacaaaattattacaatagtatagtattactacacttaattttatgtagttatgatttaatactacatctttatatttggttacatttgtcttgactgtgaataagtgtttgcatgtgttttgattaattttaaccttttatggtagattcgtgtatattttatggtagtaaatggtaaaatagattgataactacatgttctatgccttcaagacatacctttttcttaatttttaaaatatttctcaactgcgggtttgtgagtttttttcaaattattgtaaatctccaaaatcttttctaatacatttgttgaaaaaatccacatgtaagcagaactttgcagttcaaacctgtgttatttgagtcaactatggtctctttcctgagtttacagcagttacttaactgcaatctacccctccaatcttgtcccctgacctatcccattcttccttatgtggcatccagaatggcctggctccaggccaatagcatctgtacacctagctgggacatgggtagaggagctgctctcaactggccatccaaggaagatattgtatggacggttacaggggtcttgggtgtaattgatatccccaacacattgtaatattcttttaaattatatcaaactataccatcatgtcttctcatatcaaggacatattaagggggatacaaatggatggacacatgacagctaaggtctgactgtctcaatcaggtttaactaggtcctagcgaggcaattattcagagccttgttagtttaacagctttgatcttcctggaagctgaatttgaatagaaggaaaactgctgattgtgattaatgttatacccaaggatttctgtgggaaagtatatgtgcgtgcatgtgtgtgtgtgtgtgtgtgtgtgtgtgtgtgtcttaatgcttagtctgtctaattataatatctgaatcctatcaattttgtgttctgctgtcatgtagaaatgattcacttgggactaaaattgtccagatggatgaattctttggagaactgaggatttacttctttaaactcgaaaactgtgtattcggcattttgaatcagaaatgtgttatatactcccccatcaatgtaaccaatacaaattgttgttttattgattactcaggactttaaatataagtgggtacagtgatgtttctagggtcgattgagaaatagcaaggtatttgccccatcattaaatagccacagatagctattttcaactttttgtagtttttctgtctcctccacttgatatttcatgctgttgccagtgagtttacctgtagcaactcttgtttccatttccaattttgttgaatcctggagaaaccaaaccaagccttagatggttgtatgtaacacaggagtaaataggtccagaataagagtgtaggggcttatcgctctctccggtccatgcctccaagatgacaaagaaaagaaggaacaacgttcgtgccaaaaagggccgcggccacgtgcagcctattcgctgcactaactgtgcccgatgcgtgcccaaggacaacgccattaagaaattcgtcattcgaaacatagtggaggctgcagcagtcagggacatttctgaagcgagcgtcttcgatgcctatgtgcttcccaagctgtgtgtgaagctacattactgtgtgagttgtgtaattcacagcaaagtagtcaggaatcgatctcgtgaagcccgcaaggaccgaacacccccaccccgatttagacctgcgggtgctgccgcacgtcccccaccaaagcccatgtaaggagctgagttcttaaagactgaagacagactattctctggagaaaaataaaatggacattgtacttaaaaaaaaagagtgtaggggcttatctaggatcaaagtgtatacatgtcagaacagaggctttgttatatccactatttgaaattggtctttaaagactaatcgtaaaataaacatccatatattacatctgccatttgaaagtcaaaatggtagattattggcagtttcatctggttaaacctaatatatatataccatgcttgagtgagctggatcagtgtttctcaaattactgtggttagctttttttttttttgtaatttccactccatcacagactaattcttttgcaaaagacaataaaaataaattgctagaaaaattaaatgaaaagaaaacatacaaaataaaagcccgtttattttattagattataggcataaaattatattttaataaaaataatcagaacaacctcatataggaaaaagatagaaaactgcacataatatgtatacatacacttgattaatatggaaattgctgtacatgcacattttgtccttttccatcataactaaacacagttataagggaaataatgatttgtggttttgaacttatgtttttttaattcaaacaccacttaggtttcagcgtttaggtggttccattacttccctagcttctacaaataacacccgggggtttagcacttgaccataacttacagctacaaaatcaaacgaacccagcatttgagggatcatattttgagaaaaacaggtacaaactcttttgacctttttctctttggaatcattcccattgtcatcatttagtcaacaactatcactacattaagaaaaagtgtgtcttctttgagcaaaaatgtccagtgaagtttattttgccatctgttttttaaaagggcttgaccaatatttaaattggtgtgagggggtggagtgggggttttaatgtacacaagtctcttaatccctggtcagtgaagactggagactccagggcttggagaatgtgtttcttagatcaagacatctaaactgctcaaatgctaaattactaaggatcactgtgccaactgttgacttgcgacttattatttagttatggttaatttgtgaatcacgtgaatatatcaatacatcttaacatctgaaaactgattattcacctagctaatgctgtacactattgtaaattataaagtggaattaatctattccactcatataatgaaaacaaaatattcatagtagagataaaatatataaaaacaagcaagttggtttaagtggttcatcaagtctcggaatattttcattgtgtaactaaagacacttgtctagaaggtgtgatttcctcttagattggggccccacaatctgtgtttaaacaagccctccagtgattttgatgcatgctaattattgagaaatattgggtgaaagcgcacattctacttatcttcagtttttctaggttgtagggcatgaagaggaaggcaggagtgctgttaaccagcctatggtcaagttaggctgaatatagataacaatataagctggcttatctgggcattctgtcctctgtttcaaaggcagtaggcgtccaagggataacagctccccagcacagctgccttttggtcacactgcttcagtctggactgttgtcctctaaacctgatacaccggtattacccagaaacccccctcatcgttccaccttgagattaccttcaattctctcctctttcctctactccatgtcttccttttccttggcttattttcttgttttggtgaagcccaaatgcagtacttacttccaaaagaatgcatgagatgtacatttttggagtcctggaatgtctaaaaatgtgttcattctgtcttcacacttgattaattgcttggatgaattgagaactgttgacatgccattgctccatcccttcaaaaaatttccgcaatttttttattgtgataaaatacatatcacataaatttagtatcttaatgattttaagtgt

SEQ ID NO: 14463 - DNA, 18349 bp, Human
gcccaggctggtccccaactctgggctcaagcgatcctcctgccttgggctcccaaagccctggattacaggtgtgagccaccacactcagcccttggattggataattcttttggtgggggctgtgccttgaaggatgttagcagcatccttggcatctaatactaaatgccagtagccagtagtatctcctgttccaaaatgtctgaaggtgttgtaacaaccaaaaatgtatcaagatgttgccaaatgtcccttgggaaacaaaatcgctactggttgagaattctgttctattgtttatttaagacgctaatattagggaagtttgggtgaagggtacatgaaaaccctactgtttttgtaactgcccatgtctaaaattatctttataaaaagtatctttttaatattatgctaatacttgtaaaaaatgttctattaaaacttaaactttttttgttttttgagatggagtctcgctctgtcacctacgctggagtgcagtggtgcgatctcggctcactgcaacctccgccttccaggttcaagtaattctcctgtctcaacctcccgagtagctggaattaaaggtgcccactatcacgcctggctaatttttgtatttttagtaaagacagggtttcaccatgttggccaggctggtctcgaactcctgacttcaggttatccacccacctcggccttccaaagtgctgggattacaggtgtgagccaccgagcctggcttgagtgctttatgtggattaatttatttaatcttcacatcaaacagaaggatgtaattgcttatccccgctttgcagattgggaaaccgaagtacagagtaacgttaagtaatcagttcaaggtcgcatagcaagtgtcagtcccaggctttaaacccaagtctggctccagacttctcttagccttctactgcatcctgcgtctaatttgttgtgggcaggtttccctatgagttcacttcactgagcctcattctttttaacggtcacatagggttctatgctaggtgaactgtagttgcaccctttgctgtcagtgtcttcaactcccatatctacccacagttccccaactctgggtccccaaatacctcccctgtgtcccacgggctctgcagactctattttaagttggctaaaactgagcccatctcctcccacctgcacctcctccgtgttcttatatgaatgtcaatgtcggcacccactggtcacccaggatggaggaaggagccagactgcgagggaataaaggaagtaagcaggttccaaaggacgtggaaggcctttgggtccagagcctagggaaaagttgagccctgcaaaaaataaaagaggctgggttagctttggacatctgtgggaaacaggtgggaagagggaggatggaggagccaaatttaagcatcgggtacttaggtgctcatctccaaggcaactgcattgctatggcaacagcagaggcagcaccgccccgcccaagtacctcctggaccgccgttacctctgcaccagccagactcttccgcatgggagggctgggggcttgcggacctccgggaacagctcaggcaggcgggagttgctgcggcattagccaatccataagctctatcccgcctgggtgggctctgcggcgacgcgcgccaagaaggggtcgggagttttttggcgctcgctaaagggcgttgagaagggcgggcccgcgtcgcttcggaccactcaggagccgaggagagcgagtgggcggggccaggctgaggctggccgggggcggggcgcagggataacgtgggagggtccgcccagcctttcttctacccaatagaaggccagaaagccaatccggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggtgccgcgggggtcggggctggggcgggactgcgcgggcccgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcagtaataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatgtgtgccagtttctgtcctaggcattttgtagatgtgtgagcttatttagtgctttcttattattatttttggagatggtctcactgtgtggctcaggctgcagtgcagcctctgcctcccaggcttaagcaatcctcccacctcagcctttcaagtagctgagaccacaggcgtgtaccacccacccatggctaattttttattttttattttttattgtttgtttgtttgttttgagacagaatctcactctgtcacccaggctggagtgcagtggcatgatcttggcgcactgcaacctctgcctcccgggttcaagtgattctcctgcctcagcctcccgagtagctgggattacaggtgcctgccaccacgtctggctaatttttgtatttttagtagagacgaggtttcaccatgttggccaggctggtctcgagctcctaacctcaggtgatccacctgcctcagcctcccaaagtgctgggattacaggcctgagccactgcgcccagccagcctgttgtttttgtttttgttttgagacaagagtctcactctatcgctcaggctggagtgcagtggcatgatcttggctcactgtagcctccaccttccagattcaagcaattctcctgcctcagcctcccgagtagctgggattacagacatacaccacaacgcccggctaatgttggtttgtttgtttgtttgtgacggagttttgctcttgttgcccaggctggagtgcagtggcacaatctcagctcactgcaacctccatctcccgggttcaagcgattctcctgcttcagcctccccagtagctgggattacaggtgcctgccaccatgccgggctaattttttatatttttagtagagatggggtttcactgtgttggccaggctggtcttgaactcctgacctcaggtgatccaccccaccttggcctcccaaagtgctgggattacaggtgagagccaccgtgcttagcccttttaaaaatgtttaaaaattattatttagtcctttcaatgaccctaaggtaggaactgttatctccattttgcaggtgagaacaccaaggcccagggaagatatatcacatttgaacccagattcagatttgaatccaggtggcctggctgctgagtgcatggtttgagtcactccctgtcccccagcttcctctgttccatcactctgggttattttcctccttgaagttatcagggattgatactatcctgtgtttcatttgcttgtttagcacctgtctgctctcacctagaatgttagctctctaagggcagggactgtatcctgccacattggcccacgtctggagagcctgtggcacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggtgagcagggcgagggcaggggcttgggagggggtcttctcccaggtgagcctttgtagaagtcacatcagacccttcaccccagcttgctcagctgccaggcgtggtgttggccaacacaaaaacgccagtgcatgacctgaccctgaccttcacagcagccattctctttcttttccatctggcatttgagggtgagccaggtaggggcagaggacccagcctgggggctggcagacatgggttcaggtagtagctgtgcctctgtgaactctgtgacctttgggaggggactcgtgtcacctcccctagactcagctttctctgtaaaatgggcatcctctaaggaccattgtgaaggttcaagggaataaggcaatggattttgcacagtaggccctcagtctgtgggaagtgttgtcaatagtaatatcatccactaggggcctgagtcataaacataggtggatccagagagagcagtcaggaaggtagtgagtgcatgcagggtgcggtggctcacgcctgtaatcccagcactttgggaggccttggagggcagatcacctgaggtcaggagttcaagattagcctgggcagtatggtgaaactccatctctactaaaaatacaaagattagccagatgtgttgacgcatgcctgtaatcccagctactcgggaggctgaggcagggaggcagaggttgcagtgagccgagatcgcaccactccactccagcctgggcagcaaagtgaggcaccatctcaaaaaaaaaaaaaaaaaagaggtagtgagtgccagtagatagtgagttaattctgacctaagggaggaagctattccctgctctgttctgtgtttcctctgcagtctggcaccaaggtggcaaactttaaaggccagatggtaaatattttaggttttgtgggccatgcagtctctatcagctctgctttgtaactggatagcactcataactaatatgtaagcaagcacatggtcatggctgtgtgccaagaaaactttactatttacaaaatctgggaggatttggcctgcaggccatcatttgcagagccctgtctaaagctgtccagtttggctgccactcccaccctgtgcgggaggatcacttgagcccaggagtttgagaccagcttgggcaacatagcaaaaccccgtctctaaaaaaataaaaaaattagctggacatggtggtgcacgcctgtagtgtcagctacttagaagactgaggtgggaggatcctttgagcccaggaggcagaggttgtaatgagccgagatcacactaccgcactccagcctgggtgacagagcaagaccctgtctcaaaaataaataagataatatcaaaaattggtttctcaattgcactggtcatactttagctggtggctgccatctttgacagcgggaatataaaacatttacattcttggccgggcgcggtggctcacgtctgtaattccagcactttgggaggccaaggtgggtggatcacgaagtcaggagatcgagaccatcctggctaacacggtgaaaccctgtctttactgaaaatccaaaaaaattagtctggcatggtggcgggcacctgtagtcccagctactcgggagataggcaggagaatggcatgaacccgggaggtggagcttgcagtgagctgagatcgtgccactgcactccagcctcggcaacagagcgagactccgtctcaaaaaaacaaaaacaaaaacaaaaaaaaacacttttccattcttgcagtaagttgtgtctgatgcctttctcagagtccccaaacctgggctgtccctactccaaacaacccatctctcaaccatgcccagacagcctgggttgctatgcagctctgccacgtcctggctatgtgctcttgagcaagttacttaacatctctgggcttcaatctttttctccttcttcttttgagacagggtcttgctctgtcacccaggctggagtgcagtgttcatagctcactgcagcctcaacctccttgggatcaggtgatcctcccacctcagcctcccaagtagctgggactgcaggctcataacaccacacctggctgatttttgtatttttagtagagacaggacttcaccatgttgcctaggatggtctcaaactcctggcctcaagtgatccttccacctcagcctcccgaagtgttgggatgacaagcatgaaccaccgcccccagctgtcagtctttttcatttataaaattagtattagaataataagacccacttcacagggtagttgtgaggactcctggctaatacagtaaagcgggagtaacagctcctggcatcggtaaatgttctgtcattgttagtggtcactgtcattgctgttgttggttgtggtagcacagggcccagcacagagtgtacactcggtcagtattggctgttgttttactctctcatcacttggtccagttggcctgtaggatgttattacatatgcacacccccaacatggcatctaggacagtaagtgccacccgttagtcttatatgtaagcatggcagagagaagccgagttcttgcacagaatcttgaaggctgattgaagagccagcctcctgacctctgagggcagggactggatctctctctttcccctgtattcccatcctgccacacaaagcctggcccagagtcagccctcacagccttgtttcatgagccagtaggaagcaagaaggattcctggcacaggacggggcagaagtaaaggcctaggactaggatgtagccagaactctggggaaggctttgcagggagctagggggtgatgagacccttcacgggcaggtcccagccaggttgaggagggtccttgtcaggtgaggaggtttggttctttcctggaggcagcaggacatatgtggccatgtgggaccaggagaggaacccacagtgctctgctttcagcagagatctgtgaagctagaatgtcaagggccagggaagtggaaggcccagaaccttcaggggttctggttgccccagagcaagaagaagaagtggagggagaagccaggagagaattgcaagatgacccttcaggtcctcccagctctagtggtctctgttctgaggcttccggaccctataagagtgagcaggagggtgcaggcatttggggatggagcggcatgaagtgggctcctgggggtcagcagagcagccaggcgcaggacagagctgctccaagcaatcctgatgagagctggcagaaggctgaggtcggtggggatagtgaggagggcatgggtctgggtgtggtgggcgagggtgtctcgcccatctctgggttggacaggtgcacctggtaagtagccaggccctgaggcgtcaccgtaggtacctgcagattctggaatgtcagcaggagccttgcctgcccacctggtggaagctgtgggaggaattggagcaagaggcggtgtgacttgaacttgggggctggaagtggaagaagaagtgagagggagcagacccgagagagattcaggaggcaggatagagaggactgggtgatggattaggtgggcaagggtgggatgtctgggggagggtcagggcagaacagcgtggcccaccctgggctcgtacagggctggatttcagtgccagctgtgtggtcttcatttcctgagcctcagttgcctcatctgtagaatggggagagggtggctatgaggatccaggagctatgggctcagtggctggcgtgctctgcacggtggagcctcagccccagtcattggggtgtggacgatgggggagctgaggtcaagtcaaggcctctgctcacgggcagcccctgctgccaccccacagcccgtagaaagagttccggataggaccacaggaggcctggtgggctcagcacacagatgatgaccttggcacacgacctccctctcctggtatcctcctgcctgagacggtgctggggcagatctcctcagaggtcgataggaggatgcagtgaggtggccccggccgaggtacactcggtaacagatcatcatgtgcagtgtcggcgcaggcattgggcacctgggcctcattttctcttccatgaagtggatgttctcccctcgagggttcatgccgggtgatcaggagaccatgatttgggcagctcactccccagctggcagccgggctaaatctcatcagtgcccatttagatctggtgctccgcccttgccccgaagggacaggctgcctgcagagagagccgggacctccacattttctgctgaggctccttttcccagcattggctcctctgcagctgctgggccacagccagaggctgtcagagatccaagggagtcattgccagtgtccttgtctaaggaggatgggccatggagaagccctccctgcccgctctccacccagatctgttgacagccacccctcacatgcccagggcctggagggtcccagcaaggctgagactatgagcagctgtcctactcacatacccatcccagcatccaggtcagcccctttgtcctggggtcctcaaggtcactggcgcccttccagcctgctggccttgggccagcctctagcccctccttctggatcttggtcttctcagatctgaccctgtcacctctttccccgaccaggccccttcccctctggtgcctgggcagcctgggggaagtatgctggaagcagcgtaatgatctggcaaggcagaggagacagcacgtcttgaaacatttttggggtcaaggactaccccatttgttccctcactcccacctaggtcactgatgtgcattagcttggactgttgtaacaaaatatcacagacagtgtggcttaaacaacagtcatcactttccacagttctggaggccagaagtccacaatccaggttccctcagattctgttcctggcgagaacccacttcctggcttgtagacggctgccctctcactgtgcactcacatggcattccccaggcgcatgtgcacggagtgaaggagcacgagctctctggtgtctcttataaggacactaatcctggccaggcgcagtggctcatgcctgtaatcccagcactttgggagactgaggtgggtggatcacctgaggtcaggaattcaagaccagcctggccaacatggtaaaactccatctctactaaaaatactaaaaaaaaagccagatgtagtggcgcacacctgtgatcccagctactcaggaggctgaggcaggaggatcgcttgaacccgggaggcagaggtcacagtgagccgagattgtaccactgcactccagcctgggtgacagagccagattctgcctcaaaaaaaaaaggggcgctaatcctgttggatcagggccccacccttatgacctcatttaaccctagttacttccccaaagtccccatctccagatgcagccacactggaggttagggctttaacacatgaatttggggtgacacaaacattgagtccataacggatgggcagcttggatctgtcaggggcctgctctgcaacagccactgcttaagcggtcactgattcactccttggaacaggctccaacgtgggagcagcggttaccccattttacaggccagttgagtgaggctccaagaggtaaagtcacctgccagactctcattgttcaggagcagcagaggtaggatctggacctgatggagtctggagtcagcacccataacatgtcctcctggaccttggggatacactgtgagcaggctggctggggtctgccagcacagataggtgccattctgttttgcatactatttcagggggtcctgaacaccttgaagcaggtggaggcccctgctccagactgggagctcctggagaggccaccctgtgtctgtgtggttctaagctggagccacatcgaatcaggatggggctccagcacccgacagtccccatcaaatttcacaggttttggcgccgtcgggcaaggctgacacattgtcttggaggaggcccaggaagtctggccttagggtcgcagcctgagtttcaggcagatagggcatgagattccagcatttctgcttcgagccccgtggtagatccctgtctccctccttccccatggcctatttctgtctcatttattcattaacttcttgaacattcgtgaacacctgttttgtgcacagtgctgggttctgagggtgcagcaatgaagaaggccaacccagcagcctccattcctgcactgtgaggcgggcaagcaacacaccaatgggacggtagtaaatgcagcacccagggggaggcacctaacacagtgggggattaggggaggcttcttggggagaccagaggatagctgatgagtttcaggcaggacaagaggcttaaaccaaggtctgcgaggtgggagtcggaggatgtcattgtcgcggggtcaggtacaggctgagctaacaagacacacaggaccaaacccctcaaggtcagcctcacagagcaggaactcaggaagaaagcgtttttgtttgtttgtttgtttgtttgtttgtttgtttgaaatggagtttcgctcttgttgcccacgctggagtgcagtggcaacgatctcagctcactgtaccttctacctcccagtttcaagagaaagcgtttttttgtttgtttgtttgtttgtttgtttgtttgaaatggagtttcgctcttgttgcccacgctggagtgcagtggcaacgatctcagctcactgtacctttctacctcccaggttcaagagaaagcgttttaaaaaaaaaaatcattccagctacttgcgaggctgaggcaagaggattgctgcagcccaggggtttgaggccagcctgaacaataaagtgcgaccccatctctgcaaaaggaaaacaaaaacagtcattgcaggctcccatcatagcagaaaattttccaagagagctggcaggtcagaggcagatctgggtgatatgagctattggtgtgccaaagtgtggcttttatttgtttttaagtggtatggcttgcacactatgtgtgtgagagaggacaacttgggcgggctgtccaatttcagggatccctgtggctgtgtccccagccctggccgctgggggctgtggcaaggtgatgcttgttcagggcctgggcctggctcctcagacgctcagtgcctgcaggcagtcctgcttccccgaagtaggtgggtacctctgggggcaccgtgcgatcccctggctggcttagtggtccagacagaaggggggacaggggactccagtgctctgtgcctaaggccaaggagatacctagaagttcagggagaggaggggtgggagggggtcctagcaacatctggtttaagtcggagtcactggtggatgtgtctggcacagaggaggaccccgtggcagccctggaagcggggcattctgatcaaaccagggcatcacgggcagaagcctctgtaatgtgccatcccaacagaagctggggccctgtatggcatcgatgtccctgtcagaccaggacacgtgggccggcagggccaaggatagggagagcagagcagtagaggctgcgtcatccctgggatgcagtccccatggaggggaagaatgatgacagcaagggacgttggtcagggtcctgctcggtgccgggcactatgctgcatgtcacagccactggcacaagactgtcaggcggaggggcacagggatgtcagggcagcaggtcgtggtgacatccagctcagataccaggacactggtggctgccatgacgtgcagccaaacagggagctatggctgtgctctcacggtggtaccatttccactgcagtcccaagcaggttagagcgtgaggccgaggggccctggggacacttggatcagtccagtgtgttcagcaggtgccacggttgggtgtccaggcctcccagcactggctaggtcacccagcagtgttcccgtgggtctccaacaggctccaggccagtgtatcagctatgtatgtcctgggcaagttggccggcaggtgtgtcatggcatcatttaggtcagaaggagcaagggtagaagtgtcagggtgacattaagaaaccccctactgagtgtgtcagggtgaccttcacgttggagagaagaactggtgtccctggagagtggctgccaggccttagggtacacggggcgggtgcagttcacccagagggctgccctggcttgctggggctgtcgcaccactggcctagggaggacactggaagggacgcccgtttgtgtcagagcaagaggattggggtagggcaggctttggcccatgggcaccttcctgggggtggcctggagtcaggaaggcggtagccattcctcctgacctggcacgtgcacaagactgcatacacacacttgctcacacacagtcacaccacacacaccacgtgaacacacacgcagccctccccacttggcttccgaaacgtgagtcactcagatgctactctgctgccgtcttgccccctctgctggcagccctgttcctcctaactccaccagccctggcctcctccgcctcctggagagtcagagccgatgggctagtttgggccacacagggtggggccaccctgagttctgccagcatgcagactgtaggtggggagccgggagaagagctatgttgcctgcctctgggaccctggggctacagcccacgagtgtcccttgcagagcccaccagggtgccttggaggcccatcccagtgccaggctgttcttcccagatgggacagctggggccacaggctgccgtggcagtgctgggctttctctggacagctctcccacctctgcccagggggcccggggggccagccccctgcctgggtcagcctctccctgcctgctgctctcctctggcccatccagcttgtatgtagattttccctcacgtgtgtgtgtgtgtgtgcgtgtgtgtgctggtgagagtgacagcgggagcagggatgtgagacctgcagggtggcagggctcatggatgactggcggggtgcattaagtgctcatgctcgtgaaaggcacctcttcttgggtgtgggtgaggacaggtgtgactgcgcatgcaggtatgtgtgaggagaggggttgtggggagcatgtgcgcctgtgaggggaggctttccaactgaagtgctgcctcccccgctggccagctctggagtcctccatcctgtctggtcaggccccccccaacccctgacctggcactcccattccgttccatgtccacaggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcaacactttcttcctggcatcatctctaccctggggggcatggtctcttgtgtgtctgtgcacagatgtcctcatcccaggcccaccaaggtgggtacatcctgtcctctgcctcttcctttttgtggtttaaggttgagggccctgagagtcccagggcctgtcccccagaatccctctcaaaggtggggaaaccaggggtgagaggaggtggccctgagtttaggcctgtctggccaggacagtggaaatcagggacagaggggactaggcctcctcctcttcctcctcttcagtcctcggggtctacagaaaaacatcagggagaggccaggatgggttgcagggtgtggtgtgcaggtgtcttagtggggtggggcggcagcatggggccagcagctgcccacctcctccgaggaggctggtgggacagatgacatggcagggctgggaaccaggcccagggagacgagttcactaccgaagtggcccctaaatgcacggcggcggccgtagccctgcctgctatccttcatgctgtcctcgggcttcccagggcctccttaatggccctgccacccccagctgggccgccgctcagcactggcaataaacatggtgacggatgagtgtggacgagtgtgaggctcagcgcaggcaggagccccatctgtcgcggctgccacccgccctgcctcatcctggcctctgccagcccagccctgacacccccaccgcccctcctggctcccaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactgctctgctctcctgtgtctcatttctcctcagggaagcatagtggggaagatgtcgtggggaggggatcatagcccccccatcctaagggtcccagctgcaagttctcccccgaggcttccccttgccctgggccagggggagtcacagcagctggctcttggggacatgggcactgtccagctgcccagcaccctgagatctgcttccctgccatctcaggggcttccagaaggttcgtgggtccaacccggcacctggcccagcacccattgcagctgcagttaccatgacaacagggccctcccggactggagggggctcctgcagggagggggatgggagcagacatggcttttagtgcctgaaggtggagcagagggaatcctggggtgggtggcggggagatggggtcccccgccagtgtgggggctgtggatgtggcatgcctgacccccatcccctgttcagtcggggggctgtgggtctgatggagaagtggttattcctgcatgccctgttccccctccacttgatggggaccagcccagattgcgggggtgcctggctggcagagcttagggacctgagcaactaaagcccggccccaggggacctcccctcccccaagcgctgagtttctaataaaggccaagcctcataaacaatcacctgtgcccgctcccatctggctggcttcgggagcaatcgctcattcgcctgctgcctgcctgccggagcatttgtcattaggaaggtttaatgggtttcctctcagctccagagggctggggagagccggctgcatggatacaccgccaggcagaatgttctcccatcgcctggtggaggggggttgggagtgaggcagccatgccaccattcacaccaacagttggatgtggggttggggaagtgactgcacccctcctggaacagtagaggccctgggtctggaaggatcggaaattagtggctggggcccagagggtttgctgagttccactccagggtgaagaatgggctttgtgtcctgaccatcagcagcagggcccagggaaggctgtgcatcgttctgtgtgggagccgctgcccccacccgtgtgtatgtgtgtctgcgtttgcccaagaatgtgtggggccatgtgactggtcgtctctctgtcctgtgcattttgggagtcctccagttctgagagtcctccggttctgagtgtgaccacctgcccctccaggtacccccttcccttgtctgtctgtgcagtggccaaaacccaaatgagaatgtcgctgttaggtaaacatgcctccagagcccacttcggggccggtgattcattattaagcagctgcgcattccctcacctcccacccaccccctcaccccctcctgtctagaaccagggcataaatcccaggcctttaggatggtgacagtgtagtcttccctagtgccacttacaggcacctcccaggccagacccgccccagggggtcagtctctacgtgcccctggcttctgtggccgctgggcagagctggagcaggtcaccttggggtaaacggtattactgccccaggacaggagttggcttcgctgtgcccacgtccatgatgagaggggaagtcagtgagttagcagtggatagccgaagacgcacacagattgatcctggcctgggaaatgttagtctgcctgcccatccttgtttgtaacaaaagccacaaactcaaaaggagctctgagcgtgtgtgtgtgtgtgtgtgtgtgtgtgtgtgtgtgtgtgtgtgtgatctctctgaggacctgatacagatgtgatggacacacccacacccagccctaatctcggtgtgaggatgtggctccccagcactcagcatagtgtggacacagattgtggacctcagcagcctcaattctccaccttactttaggagaatccagtatctaaggccgataaactacctcgtcccctcactgtggagactctctgcc

SEQ ID NO: 14464 - DNA, 14205 bp, Human
atggcttctattttccctggcagaggatgttggacccaaatccaatccatgtgtgagttgttcccagggaagtgacgtgccacgctgcttcaccccagccttgggccgccgggcttgacatgctcaactggggcaacggagcaaattcccagaacaagttttgagaaagatgattcagagctttgcagaggatgaggaaaggggagagcttgcggatccttgctgccaccaggactggcctgggggcacgtggcaggcagaggcaggctcaggtgcacagggagcctgggtgttggggctcagggtctgctctgagcgccccagtgggcacagctcaggttgatctctgagggcaaatgatgagagctaaaaggcagcagtgtgagtgccaagaatgtgtgctaggcacagcacatgcatgatcctgtatgaacgacaaggagaacagggacacaggtggacggcactgaggctacctgccgagatgtggtgcctgggaggtagagccagaacctgacacagtcccactgctttttcaaggagatgcagtgagaaagcaaaggcagggtcttggcaggaccaggtgtgagaggaggcaaggcctccttgtggtcctgctcccagggggtggcatgtatcccaggcccagcagcctccactgtggcctccccggctgctgcctgctccaactcactcggggctgctctggggacccaggtgcttcctgacccacttttcctctttccttttgaccccaggtccaaactctgccctgtcaatcatcccaggggctcctaggcttccctacctgactacttcactggggccaaaccccgcagacaatcgtggcttagggctgtctgcctctgcacttggcccatggactacctgtgagctttctcttgtgtcctcattcctttaagggggaatgtcctcggagctctgtccttagctccccattcctccagtatgagacagggactaggcttgagtcacgggggactgtgctgtgtcacgccctgccatactaatgggaccactctgcctgttgatggccgttgtagggcagccaacatttgccctggagaagccttatggcaaacaccaggcaccaaggtgcacatccctgatggatcctgggatcagttgacactcaatccacctgccttctgggtcctctgggccctctgggtccatgtggcagctggaggtatggtagacactttttaaaaaatgagttctggtaagaagaaggtgataaatggctatttgtccacgttgggacccggaggggagggatggcatgcccttacatgggactcctacccccagcggggcagctggccactctgagggcagttttgcacctgcctcctggctggaaagtgagttcccactgtgctgtccctccctggggcccagcacggggcccggccccacaccgacctgaagaggttggtaggatgactgaatgaattgacgctgggatgcagcagggcccatgggcagaggctccagagcctgggaaggatggggtggcctttctgtggccctccgaattgagagaggtctcagaggcctgacaccacggctttccgtccagggttcctggtcacccgcggagggctcagagccccggtggactcggggtcccgccttaaggggggtgcctagggcagaaggaggagggatgtcggccccctcagacccgcaccccaggccctccccaccacctttccttccctcaggccctctgtcttcccagtcgccccgccccctgcccctctgtcctaggcgcaagtctccgggcttgggacgctcgccgccagcgcccgcccgcctgccccgcccctagccccccgccccccgccccccgcccccccgcagcccctccgtccactctcggctcctccttctcttcctcctcctcctccccgggggtggggagccggctccggaagccccggcgcccccgccccgggccccgccagcgctttggagacggctatccgcgcgggagtgcgccacgcggggccggagcgcctattagccgccagacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagagcccagggcagggcgggggtgtggggggctggcatctcaggtgggaacagggggattcggtagggtctggccactccccagtctgctaggggaggaatggctggcttactaatgcgcacgcgagcccagatgcctggagggaccctgtgctaggccgaggtcagcgctggcgtggaggcacatccagcacccgggcggcagggccgcttttgggggccggtggctctagggttggtgctgtggttgtacgggtcgtttatccccattcctccagtacgcgacaggtactaggcttgagccacaggggactgtgctgtgtcaccccctgccatactaatgggaccactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacgggaaattagatgaggtgatgcatcactgaagcatttaacccacggcctcttgcataatcagttgtcagtaaatcttagctgttttcatcgtggccctctggaaggtggcagagggtcttgtgatccctgtctcccaggagattccaaggcaccatccaacattcctgatgtcagcagcccctcccctgccaccccagctctagatctttcctggctgcttcccacaccctgggctgcctgtgcccctcctgcctctggctctccttccaggcttgctctcctggctctggggcaccgctctagcagccctgcgtcccctggctgtctgcatttggtagctttcctgtgtttctgccaaacttccctcatgctccccacctctcatcaggttctcaacagcacttgcagctcctgcttagggtcctgggaggattcccatggggaatcctcacaaccagtccctgctccctctcccagactctgaaatgagtgtgcagccacaagctccctacctgtcctttctgtcctctgtgtgatccctgaaccccccaggactccctatccttccaatcaattccaaaccccttacttctcgaaaggagaccacttcctcttctttgggcttcaatactcaaccaagtgtcccttttctttgaagcttttcttgccccgtaggagaccaggggaaggtcttgggcccatgtcccttcctttgtatggcagttggcagggatgaccagatgctcctccaggcctggatggctcagtcacctctctgccccttctgtgcccagaacagaatagtggaggagtggatagtaaggaacccctattgaggttttggcaggtggggggatgagggcctccccctgggaactgggaaccctacgctcagtctttagagaggttgagattggtggtcacagccccagacttgcagacagaaaatctgggtccggatcccagtttgccacttgggcaaatgacttaacctctcagtttgctgatccgcactgggaactgacaagagtccctgtgcccaggttctgggcatctagagaggggcctcatgggggcacagagctggctctgttcatttgacacgagtctgcatcttggacagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggtttgtgccgggctcctctggggtgatggggctctgactgcctgctcgggtggaggcagggagtgggaggcaggtttctggggccctgcttcctatagaccttcagctccccactggatgggaacctcacttttgctataaatttcacaatttgattggtgggctccctcagtgctgtagcctcttttgggtagggagagggcttggcagccttttgggtgggacctctgtccctcaggcccctgcccagatgtccctgggctctgagcccatggagttccctcctgccttctcccgctggggacagctttgtggtagggcctccagcagcacagtaggttccccagaaggtgggcccagctctctggccccatgagatgccagcaggatgctgaaggccagaggagctcaggcctccttggagtgagctcggcctcaggagggtgtccacaggctctgtgtgggctctatgggtggctggtggcctgaggctcccaaggtggtcagagcaggcctcccgcccacctgcttctggaactcctgtgttgcaggggcgcccctctcaaataactggcagaatccaggagaggagacccatgtggaggcacgggagcaccagcctggtgagtggccgtcatccgcctggccttggggccagctgccctggctggttggactgagggcttccccagagtaggcctgggtggggttgtcaggcagctaccagcgctttcccctcagagccggaggaggagaccgagcaacccacactggactacaatgaccagatcgagagggaggactatgaggactgtgagtagggtcctgccagccccacctgggtcggacccctggcctgggggatgtgccaatgggcccatcccagccttgggccccactctgagccagcctccccctcagttgagtacattcggcgccagaagcaacccaggccacccccaagcagaaggaggaggcccgagcgggtctggccagagccccctgaggagaaggccccggccccagccccggaggagaggattggtaggatggggggcaggagaggaggtgccatggccacgggcgctctggccccctcctaacctccccgcctccccagagcctcctgtgaagcctctgctgcccccgctgccccctgactatggtgatggttacgtgatccccaactacgatgacagtgagtacccagcaccccagagtctgagggacataggcaggtgggggtcggggctggggtgtggtcaggagccagctggggcaactcacccaccttgcaaccccacctgtgcccgtggttacctcgctgtccctgctgtccctgcgtgcccaccccagccactgccctgtctcctctgccctcaggctggtctttccttggccgcttccctggttcctgcttggctgtgacccccacaggggtgtccctaggcacacactctgccctgtcacccatgtgggttccagccctcccagtcctgtgctctaactggcttcccgctggctcgtggccactgccccactctcttcagggagcccgagggcttttgcctccctgttgctcatgcccctgcgtccctggagccctcaggttccctttcctcctgggtggcagcccgtgcatcgccatttccctgcccccaggtccccatcagtgcctccaatgtctccccatctcaccccccagcccgcaaccccaggcacaggtgccagttgtccctccaggcctttcccatgccctgggcctcgagtcctttccccaggccagatgctcctggaaggccgggctggtgacttcagcagggtcttgctcagctgcccctgagctcgggctgctcctgactcctgcaagaccctctcccaactcagctgtcccccatctcctgtcctcctcccctctggcgcggtcctgtcctgctgagctcctgtggacccaggagctgaggccccgcagcagggtcagggcagcctcagctggctctccctccccatagtggactattactttgggcctcctccgccccagaagcccgatgctgagcgccagacggacgaagagaaggaggagctgagtgagtgggaccaaggacttcccacaccaggcctgccctgaaggccacctggggcctgcctgatccaccccacatggtcctcaaagcccagagccaggctgactggcccctcctaccttgcaccttccagagaaacccaaaaaggaggacagcagccccaaggaggagaccgacaagtgggcagtggagaagggcaaggaccacaaaggtgtgtggctggggcttggggcctgggtccctgtggggcagcatctggactcctgattgcctcccgggcccttggtgccatgtcctcccttcattgtccctagagccccgaaagggcgaggagttggaggaggagtggacgcctacggagaaagtcagtaagtggggggcacaagggggtgagggtgggggccacaggatgggggtgctgggacaagtgactggcccaatgtcacaaacaggacccaggtccccggaaccctttcctactcagattcttgggacccagaagggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctccatgctgcgccacggcctgggggcacagcgcggccggctcaacatgcaggtgggcattgggatgggcccatctcccaactgggataagggactcctccgcccatgctcagcctcccctgccccctggacagaccggtgccactgaggacgactactatgatggtgcgtggtgtgccgaggacgatgccaggacccagtggatagaggtggacaccaggaggactacccggttcacaggcgtcatcacccagggcagagactccagcatccagtgcgtggccaggctcatggatagttggcagaggggagtggctacataggcatggctctgtgtcccattaaggagattccagtgggcccttctttggcccagccaaagaaggccaaaaagatcagtgagggactcaccctgcccatccccactcctcagcctggtcagtcagcccctgtgtcctgatagcacatgagtttagggacagatcacctgcccatggctatgtgacgggcataggacccaggctcaacacctgggccgtgcagcaccaccctgctagctcttaaattcttggggctcggaagagggaggctcaggccacctgagggcctgggagggggaagacccttgctctgaccactgtccactccacagtgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccgtgagtgtggagggctggcaggggctctgagtggaggtggggtgctagggtgggccagccggcacccagctaaagacaaccccgcctcccttgcagctgtctacagctactacgcacagaatgaggtggtggccaccgatgacctggatttccggcaccacagctacaaggacatgcgccaggttgggagcatatatcctggggctgggggtgggacctgtctgtggctgacgggagtgtgtgcctggtgcttctgtcactgggcccagtccctactggttccagggatgctggctgtccctcaccttaggaaggaggccagtacctgggggctgcgtgaaggggtcatgcccgtccctcgccatagagcaggccctggaagtggaaggggcatggtcagcgggggacggattgcatgattgattccacgtcctccccctctgccccagctcatgaaggtggtgaacgaggagtgccccaccatcacccgcacttacagcctgggcaagagctcacgaggcctcaagatctatgccatggagatctcagacaaccctggggagcatgaactgggtgagggtctgtgggggccagcagctggcctctgctgctgatgtgcagagctcactgcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgctggctccccacagggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtgaggctacagcctggctgaaagggcaggagggagcagctggaccctggggtcctggtgttctgggcttgggggtggggctgacggtgcctgaactccagacgctgaggctctgggggttgggggacaggggatcgtgcgagtactggtgtgaagcttcatggagggtgatcgggctaggttggggatagtggccggaggctgcagccctggcctcacacgtgctggccactccaggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggagtgagtcagcctgggaggggctgtgggcggggcctggtccggagaggggctgactttgggtctgtatctgtccccggccagctatcaatgacttcagttacctgcataccaactgcctggagctctccttctacctgggctgtgacaagttccctcatgagagtgagctgccccgcgagtgggagaacaacaaggaggcgctgctcaccttcatggagcaggtggggtggctagggcaatgcctggggagaggaggctgcacaggctcctggatgggcgggagggagcagcggaccacattggaccttcctgaggaccagcagccctcacctgcttccctaggtgcaccgcggcattaagggggtggtgacggacgagcaaggcatccccattgccaacgccaccatctctgtgagtggcattaatcacggcgtgaagacaggtacctagtgtgcacacctttaccccatctttctgagggaggacccgccagagagggtgggggcttgaggaactcagcgagcaggtagagtctggggagcctgggggcgaaattcagagagggagggcggtgcctgggggcgggaactcagagggggagggcggggcctgggggcaggactgagtgggagggtgggggcctgggaggggcgctctggggcagccggatcgttctccctccgcagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcacggactgctcacattctgaggtgtcagggatggggaggagggagaccggctggtgggtgcatgggctatggtcactgtgggcacccctgcaggagtcccatagccagagtgcccagggctcaaggctcgcatcagcaagtgctcaggctttatttacaatgccgacactgcagggaatgaacagcctccatctgggcctctctggtcaaaaccacttttttgagtcaggggcccagccccaggcctcccaggtcatcgtcctctgccccgaagcccgagaagctgatgggctggcaggccaggctgcgcaggttcacaaggcaggcggtctgcgtggcactgaagtcagggacagtcaccaacagcactgtctggtcctcaggacctgcaaagaagtcacataggacccactgtaggttccaagtaagtcctgcctcaaagagaagctgccagaaataaacaggagtccccattggcacacagtggggcagtgacaataggagaccagagattagccttgagaggcacacaggctgggagccgttccagtccctgcccagctggcgaggcagcttggctcccacagtgaaatggcagctgtgcagaagacctcagctgtccatcccacaagggccagggggactccacaatgcaggttttcttctctgtgaaccttgtccccaggtgagagcaaatcagcaaatcaggcctgggcccccagaagacaaaaattacctcggatgattttggagccaaagctgggggtgttgccacaaaagtagacatgcgggcactctgggaagatgaacgggtcagttttgtagaaggggtaacaacctggaggagaaggggcagctctgaggagggttccgcctcagcactagcactctgcacaggatgtggggctgcagcccctcctcccattgcaggccagtaggagacccccagtgtgacaataggggcacctccagacattgtcacaagaccttggccctgctgttgctgcccgttggggtgggcagccattggccttagaattaagattccagagtagcttccagagcaggtgccaagcctctgaacttctcctcagacagttctcagcaatgctggcaagtgcaaacccacagggggaccctgtgcacttcagggtcctgccaggcctcctggccctctgctcccaccctgtatggctgagcctgttacctagagtgtcaggggctgtggggctgatgtgacggacccgcagggtccactccaggatctccaagtgatcctccatgctgctgtatcggaaaatgtcactcacgttctgtcctgatgtccccaaaaatctgcaaggcaaagctcagctgactcttggctttgggtgccacccatagtggtcagcccagagctcatctggcgctcttgtggggatgccccagagagaaggaacagatgctaggtgggcctctgcagccctgccaccttcctgggccctccctcccctcccttctttgtgcctcctgaggcaaaaggctgggtcagactgaagtgtggctgtgccagctacctgactccatcaatggtggcctggtaggggttggtgaccagctggagcgtggagtaggcagtggccagcgggaacatgcaggggtggaggggctgctgggggagcgtgtaattggtgggatcaaactcgcctggcatcacgtccacgggcactgaggcctggaaggcacagggcagggagagctcacagggccccgaaggagccccctacaccaactccggccactccccctgccctcctgcctgccttctgttgcccagtggcagctttgaagactgcaatccccatcacccctccagcccccagctcgctcacgctcagctgcaggaggatctcatccagcatcttaacagcctccacgctggctgcctgggttttcttggtgaggtatttggcctggaatagaagcccagaaggccatcaggcccaggcgagtcccaggctc

SEQ ID NO: 14465 - DNA, 18605 bp, Human
actctgtcacccaggctggagtgtagtggcgcagtctcagctcactgcaacctctgcctcctgggttcaagtgattctcctgcctcagcctcccgagtagctgggattacaggtgcgtgccaccacacctggttaatttttgtatctttagtagagacagggtttcaccatgttagccaggctggtttcgaactcctgacctcaggtgatctgcccaccttggcctcccaaagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaaggtaagggtatgattccttatttggaactacataaagtgaccttgctctacttctcttccccataccctccttctcccctccccagccccactttcctattccaattagggcaattctatgaaatcacagcatcagaatcttaggccttaaaatcatttagtctggccaggtgcagtggctcacgcctgtagtcctagcactttgggaagccaaggcaggtggattgcttgagctcaggagtttgaggccaccctgggcaacgtggcaaaatccagtctctacaaaaaacacaaaaattagctgggcacagtggtgcgcacctgctgtcccagctactcgggaggctgaggtgggaggatcacctgagcctgggaggtcaaggttgcagcaaaccaagatcctgccactgcactccagcctgggcaacagagcaaaaccctgtcaaaaaaaaaaaaaaatctggtctaagcaccacctttgatggaggcaggaatcctgcagcagcctggagccaacccaatggctccctgcctctggtgctctatttcttatcaccatacaggtctctaaggtcacctttaggtctaacattgtatgaatgattgtcagcaactttccaatttttttcatatacatatattttttttattttattttttactttttctttttttgagacaggatctcactctgtcacccaggctggagtgcagtggcgtgatcatagctcactgtagcttcaacctcctgggcacaagtgatcctcccacctcagcttccaaggtacctgtgactacaggaatgcgccaccatgcccggctaattttgttatatatatatatatatatatttgtaccttggttttctcatctgtaacaccaggggttgaagtgctgtgatattttttggttctaggataatttggaaatagggatctcttaacatcttggatactgccaatagatcattcacgaaatccctttagatgagtgttatgtttacttaggtctctaaaacaatttgtaaggtcaacagatggggataagaatgacctgaagctggtcgtctttgttcgcaaccagaaacagtcctgcctcaaaaaaaaaaaaaaaaaaaagggagtaggcaggtggccatatttgtttctggcaagtgagtgctgaaggaaaggagctgaagcctcccacagtcataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggtgagtggcctgagacttcagcgagtgacaatggcatgagaagagggaagtgaccggaggaaagggggaagaaagagttaagctgcgcaaaggagctgaacccacaaatatttactgaatccactggtttgccccaggggcagcatgtaaaatttccaaacttcactccttatcaccttccggatttagcaagatcctcatacctaccacctgtaggattatttacttttttcttccagccaattcagccttaacgttttttagtgcacatatttttaaaaagaaaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactcctgggctcaagtgattctcccacctcagcctccaagtaggtgtggctacaggtgtgcaccaccgcatctgcctaatttttatatttttttatagagatgggggtctcactatgggacctgggctggtctcaaactcgtggcctcaagtgatcctcctacctcaaccttccaaagtgctgagattacaagcatgagccaccatgccgggcctgaacctttttttttttttttttttttgagacggagtctctctctgtcctccaggctggagtgcagtggcgcaatctcggctcactgcaaactccgcctcccaggttcacaccattcttttgcctcagcctccggagtagctgagactacaggcgcctgccaccacgcccggctatttttttgtatttttagtagagatggggtttcaccgcgttatccaggatggtctcgatctcctgacctcgtgatccgcccgcctcggcctcccaaagtgctgggattacaggtgtgagccaccgcgcccagctttttttttttttttttttaattttattttatttttgagacagagtctcactctatcacccaggctggagagcagtggcacaatctcggctcactgaaacctccacctccaaggttcaagctattctcctgtctcagctccccgagtagctgggattacaggtgcgtgccaccagacacagctaattttttgtatttttagtaaagacaggatttcaccatgttggtcaggctggtctagaactcctgaccttaggtgatccgcttgcctccacttcccaaagtgctgggattacaggcgtgagccaccgtgccccgccctgacataggggctttgggatcacagacttggattcacttccagcctccaaggcctctcccagaaactctctgtgaccactctccttttttttttttttttttgagatagagtctcgctcttgtagcccaggctggagtgcaatggcacaatctcggcttactgcaacctccgcctttcgggttcaagtggttctcctgcctcagcctcctgagtagctaggattacaggcatgtgcaacttcgcccagctaattttgtattttttagtagagacggggtttctccatattgctcaggctggtctcgaactcctgacctcaggcgatccgcccgcctcggcccctcaaagtgctggaattacaggtgtgagccactgcactcggcctcttcctttttattttttatttttgtgacagggtcttgctctgtcacccaggctagagtgcagtggcatgatcacagttcactgcagcctctgactcctggactcaagcaatcctcccacctcagcctcccaagtagctgggactacagtgcaagccaccacacctggctaatttttaaattttttgtagagatgggggtctcactatcttgcccaagcaccaaagcctgtatttttgaccccaacattgaatgaggatgggatctggtgatagagggaaaaaaaagagggggctgattgaagggcacaggtaagggaaggtttggcacaaaggctacagatggctgcaggatgaggagggagttgagacctgtcctgctccttccaggctgctgggcctttgcaacaacttctcttatgtggtgatgctgagtgccgcccacgacatccttagccacaagaggacatcgggaaaccagagccatgtaagtgactctctaccaccaccaccatggttagtccctgtgggaagatgagggggtgggacaaggtggggtaaagtttccagtctctggctgggcacagtggctcacacctgtaatcccagcagtttgggaggctgaggcgggcggatcacttgaagtcaggagttcgagaccagcctggccaacatggtgaaactccgactctactaaaaatacaaaaactacctgggtgtggtggcacacacctgtagtctgagctattcaggaggctgaggcaggagaattgcttgaagccaggaggtggaagttgcaatgagccaagatcacaccactgcactctagcttgggcaacagagtgagacaccatctcaaaaaaaagaaagctcttgaatgtgttatctaaacaaagtccatttacagggccatctgtggcctgtggtctagtagtgtgagactcatatggaaaccccctcttcattgtgcatgcagagacgctgaggtcctgagaagtcagtcactgctgacccaaagccatccttcaagtgaaggcagagctgggacgggagccaggctctgtgtgtctatccctctgcctccagggtgaaagacatgcttttctcccattaggtggacccaggcccaacgccgatcccccacaacagctcatcacgatttgactgcaactctgtctctacggctgtgcgtactcatctcacctggtccttgcctgacccagggcccctgggtctatagaccccactcccagcccttcactacccagctgggactgtcatgattaaaacagttgagacctgggctgggcgcactggctcacacttgtaatcccagcactttgggagaccaaggtgggaggatcacttgagcctaggagtttgagaccagcctgggcagtatagtgagacccccatcttaaggaaaaaaattaaaaaatatatatatatataataattgagaccttaatataatttctgaggctgaggcggatggatcacttgagaccaggagttcaagaccagcctggccaacatggtgaaaccccatctgtactaaaaatacaaaaattagccaggcatggtggtgcacgcctgtaatcccagctactcaggaggctgaggcaggagaatcacttgaacccaggaggtggaggttgtagtgagccaagatcgagccactacactccagcctgggtggcagaatgagactcactctcaaaatatatatatatatagtttctgagtcctttctgtctgcaccatatattagctcatttaagccacacagcagtcctgtgagctaggtgctatgatattcccattttccagatgaggaaactgaagctcagagagtataaactcttgacacacaactaaggagtgggagagctgagacttgaacccaggcgtgcctgactccagagcctgtgtttgtagcaggcctgtttggccagctcctgcctctccttggccacgtggttgggagggttgtcccctggaagctctgcggtctcactctattctcctgtcccaggctgtgctcctggcggacatcctccccacactcgtcatcaaattgttggctcctcttggccttcacctgctgccctacaggtctgggtgagggtagtgggaggcagggtgggcaggagctgagaaaggggaggctgggatggctgagatgctgagagtagagaccgaccttccccctcccttcccttctcaccccctcagcccccgggttctcgtcagtgggatttgtgctgctggaagcttcgtcctggttgccttttctcattctgtggggaccagcctgtgtggtgagtgtgtggttctgtgtcagatggggagccccgaggaaccacatcagagcatttgtgggaagagtctccccagcctcccagaggaaagggattcattctgtcacccttagaagcctgctagggctatcagcagtaggcgatgggagactgggacaatttggaggggtaggcagtggaggagatgggagaaaatggatgaattagatggagattgaggtgaacaaagtcaagactctgtgatggaccaggcacagtgactcatgcctataatcccagcactttggaaagccaaggcaggcagatcacctgaggtcaggagttcgaaaccagcctggccaacatggagaaaccccgtctctaccaaaaatacaaaaattagctgggtgtggtggcaggagcctgtaatcccagctactcgggaggctgaggcaggagaatctcttgaacctgggaggcagaggttgcagtgagccgagatcacgccactgtactccagcctgggtgacagggcgagactccgtctccaaaaagaaaagaaaagaaaaagactgatgaaggggcagagacatcaagggtgcatgtctgcccctggtctgataactgggtggatggaggtgccactctccatgaagggacacgcaggggagtggggctctgcttcagacctggaacctggcctatgcatgggatctattggagcctctatgagctgatactgaggaggccatggccagacacattagaggcctgggcagtgtggcaaggtgtggtgtgaccatcccagtgcttgtcctccccccaggtgtggtcttcgctagcatctcatcaggccttggggaggtcaccttcctctccctcactgccttctaccccaggtaagcaggtggagcagggagtgtggggagaggctgtcccatggtcagcctaggtcctcctgaatgttcctgtgttctccttcccagggccgtgatctcctggtggtcctcagggactgggggagctgggctgctgggggccctgtcctacctgggcctcacccaggccggcctctcccctcagcagaccctgctgtccatgctgggtatccctgccctgctgctggccaggtgagctgccctgagccgggagggagaggggtccaaggagagaaaacttggccatggctgggtgtggtggctcacgcctgtaatcccagcactttgggaggccaaggagggcagatcgcctaaggtcaggaaaccagcctggccaacatggtgaaaccccgtctctactaaaaatacaacaattagccaggtgtggtggcgggtgcctgtagtcccaactactcaggaggctaaggcaggagaatcgcttgaaccccggaggcagtggtggcagtgagccgagatcgtgccattgcactccagcccgggcgacagagttagactctgtctcaggaagaaaaaaaaaaaaagaaagaaaagaaaacttgattatgattgcaatcttcaagtccctaccttgctgtgaagggaggcggaatctggactctgatagccccaggtgtgagtcctggagctgccactttttagctttgtagcgttgaacaagttactccacctctctgaaccctcagtttccccatatctcaaatggcagttgttcttgctttccttggaggtgatgagggtaatgcattcagcacagtgtggttcccaaggtgattagaagtaggatgagggtggactttatttgattagttccttttttttttttttttttttttaatcagtgttgaccaggttggcctcgaatgtgtagccttgcctgcctgagtgccagggcaacaggcctgaaccatggcgactcccttttttttttttttttttttttttttttgagacggagtctcatggtgtcactcaggctggagtgcagtgactggtgtgatctcagctcactgcagcctcggcctcccgggctctagtgattctcctgcctcagcctcccgagtagctgggactacaggcccatgccaccatgcctggctaattttttatatttttagtagagacggggtttcactgtattggccaggctggtctcaaactcctgacctcaagtgatccacctgccttggcctcccataatgctaggaatacaggcgtgagccaccgcgcccggcctgattagttctgtgtattttcatgcatattacaaaacactttggccgggcatggtggctcacatctgtaatcccagcactttgggaggccgaggcgggcgcaccacgaggtcaggagtttgagaccagcctggccaatatggtgaaaccccgtctctactaaaaatacaaaaattagccaggcttggtggcgcttgcctgtagtcccagctacttgggaggctgaggagaagaatcgcttgaacccaggaggcagaggttgcagtgagccgtgattgtgccactgcactccaggctgggcaacagagcgagactccgtctaaaaaaaaaaaaaacacacactttgaactagccagacacacctggcccttcacaagattagtgcttaggacaagtctaagtagaaaaagtgagtccatttaaagaaaaatattaagtaaaaatatatatatacaggaggaatatggatatggcaaataacatgaagccagaacctaagtgactaaaatcgaggaagttctggcctagcacagagtgaacgtataattaatgggagctagagcgaccattagaataataatggccagaaaacagaactgactcgctaggtatgagccagcagtccgaacaagggcctgctgagcacagtggctcacagctgtaatcccagtgctttaggaggctgaggctggaggaccactagaggctagaaatttgagaccagcctgggcaacatagcgagactccatttatacaaaaaatggaaaatatgaggcgggcttggtggcacgtgcctgtagtccccgctacttgggaggctgaggcgggaggattgcttgagcctgggaggtcgcggctgcagtgagctatgattgcaccactgcattccagcctggatgctggagaaagaccctgtctctgaaaaaaatcaaaacaaaatgaaggcccatgaataggaataaggagataaattcaggtccaaagaaagaagcctttgtccacaattggagctctcccgcacagcgtaggagccttagaggcagtgagctacccatctttgaaagtgttcaaaggtagaggtgttccctgggaaaagtggcctagatggtccctggggaccttcccagccagtagggttttctgaccctgccttcatcctactcctagctatttcttgttgctcacatctcctgaggcccaggaccctggaggggaagaagaagcagagagcgcagcccggcagcccctcataagaaccgaggccccggagtcgaagccaggtaggagacacagaccctcagagaggtcactttctttctctctgggtttggccttttcctctctgcaataggcaaagttaagaggggaaagagagtgagtgtactggttatgggaaaagcctttgtctatttgagaaatacttgttgaggacgagcacagtggctcacgcctgtaatatcccagcactttgggaggctgaggcaggaggaccacttgagctcagaagtctgagtccagcctgggcaacagagcaagaccttgtcgcaaaaaaaaaaaaaagaaaagaaaggaaggaagggagggagagaagaagggatattaattgagtacttaccatgtgccaggcattccaatcacaagtgctgaggccctgcggtggggataagctgggatgttctagaaccagagaatggccagtgagactgggcagggtgggccaatggccatctgtggagctgtacaagagacattggccgggcgtggtggttcacacctgtaatcccagcactttgggaggctgaggcagatggatcatttgagatcaagagtttgagaccagtctggccaacatggtaaaaccccgtctctactaaaaataaaaaaattagccaggtgtggtggtgcatgcctgtagtcccagctacttgggaagctgaggcacgagaatcacttgaacccaggaggcagaggctgcagtgagctgagattgcaccactgcactgcagcctgggcaactgagtgagactctgtctcaaaaaataaaaaaaattaaaaatcaaagagacgtgaagaggtctcacctggttagcttttattttcatcatgataaagtatgtatattacttgaagtttaccattttattattttttatcttactttatttttttgaggcggagtttcgctcttgttgcccaggctggagtgcaatggcgcaatctcagctcactacaacctctgcctcctgggttcaagtgattctcctgcctcagccacccgagtagctgggactacagacacctgccaccacacatggctaatttttgtatttttagtagagatggggtttctccatgttggccagggtggtcttgaactcctgacctcaggtgatccgcccacctcagtctcccaaggtgctgggattacaagcatgagccactgcgcccagccattttaaccatttttaagtgtccaatccagtggcatggaagtgagttcccactgttgcgtggtctggttaattctgtcataccggtgcctctttgccgagtcttcagtgtgaaaacttcatctgcccttctctctctgttcccctgcaggctccagctccagcctctcccttcgggaaaggtggacagtgttcaaggttcggatgatggctggggtatgtccctgtggggcttgctcacctccaggccccccgcttatatcttctgccttttccagggtctgctgtggtacattgttcccttggtcgtagtttactttgccgagtatttcattaaccagggacttgtaagtgaggggtgctaggaggggtgtggaggtggcgattggggctgggacccacacagccccgtccatctcccctgtctggtatttgttgcagtttgaactcctctttttctggaacacttccctgagtcacgctcagcaataccgctggtaagaggagcgagggcagtgggctgggagggcgccgtggtgatgcagctgccctgcccagtaggcaccggggggagcgggatggtccctggaggagcctcctctcctccccccaaccctaacctcaggtaccagatgctgtaccaggctggcgtctttgcctcccgctcttctctccgctgctgtcgcatccgtttcacctgggccctggccctgctgcaggtaccaaacccctgcccctcacttcactcccaccttggctcccagcttggctcccagcttccccaaaccccctgcttcccactatcagtgggaagtgtaaatttttttttttttttttgagacagagtctcgctctgtcgtccaggctggagtgcagtagcgcaatcttggcttactgcaacctctgcctcccgggttcaagtgactctcctgcctcagtctcctgagtagctgggattacaggcgcccgccaccatacctggctaatttttgtatttttagtagagatgggattttgccatattggctggtcttgaactcttgacctcaggtgatctgccggcctcagcctcccaaagtgctgggattacagggaagtgtaaattgtacactatcatttcttagcacagggaaccaaagtccagcagagctccatgtaaaatgtatagcctcaggagccaagcaaaactgagcttcagtactcagccactgtgtgacttagggcaggtctcagaacctctctgagcctcaatttcctcatgtataaattgggtgtggccaatacctatttttcagggtagttgtaagaaatagagatgagagaaagaatcgaagaacaagattttgtagtgtgtgtgtgtgtgtgtgtgcgtgtgtgtgtgtgtgtgtgtgtgtgtgtgtgtgtgttttaagcattgggattgggccgggccaggtggctcatgcctgtaatcccagcactatgggaggctgaggcaggtggatcatttgagcttggtagttcaagtccagcctgggcaacatggcacaatcacatctctacaaaaattagccaggtgcagtggcgcacacctgtagtcttagctactgggaagctgaggtgggaggatcacttgaacccatgaggtcaaggctgcagtaaccaaggtcatgccactgcactccagcctaggcaatagagcgagaccctgtctcccagaaaaagaaaaaagaaaggaaaagtcggaaccttcctctgtcgcctaggctggagtacagtggcatgatcataggtcatttacctcaggcaaagagacaggctttcaaataatgtttctaactataagaaaatgtacagttcttttattctagatagttaattataatagaattggtgactttgaagtcagtgggttatttatcttgagggtggtgagcaaattcaactgcccttggcaaacagtagtttacagctttaagggcgcaaacacccttccttacaacagtctaataaaaggagtttcatataaccagcattcattgtttcaaggttacaaatccacagcccctgcaggtaactgttacaataaactgtcaactgtgacaggaaagtcttctgcctttgaaatttaggaacttggccagtcctggtggctcacacctgtaatcccagcactttgggaggccaaggcaggtgaatcacctgaggtcaggatcaggagtttgagaccagtctggccaacacagtgaaaccccgtctctattaaaaatgcaaaaattagttgggcgtggtggcacctgcctgtcatctcagctactcgctaggctgaggcaggagaattgcttgaactccggatatggaggttgcagtgagccgagattgcagtactgtactccagcctgggccacagagcgagactccatctccaaaaaaaaagacttaggaactcaattctgtgatagcaaaatacagaaatagagattatactttaggctaggtgttgtggctcacacctgtaatcccaatgcttttggaggctagggtgggaggatcactcgaagccaggagcttgagaccagactggacaacatagtgagaccccccacctctacaaaaaattaaaaaaaaaaataagccaggtgggagaattgcttgagcccagaagtttgagagagcagcctgggtaacatcacgagacctcatctctacaaaaaacaacaacagggtgtggtgacattcacctgtaatcccagctactcgggaggctgaggcaggaggatcgctttagcccaggagttccaggctgcagtgagccataatcatgccactgtaccccagcctgggtgagaccctatctcaaaaaaaaagattacactttcatattatggcaaaagcatgtaaatatcctccagcctccttccttatttatctgagcagtgctgcaagcccagggtttgtacccacaaaaccccaaatttataactcagggtgcttgtagataccactgaaacatgtagcttatggttttaagctacatgtttttagctataatgttttttgttttgttttgttttttgagatggagtctcgctctgttgcccaggctggaatgtagcggtgcaatcttggctcactgcaacccctgcctcccagattcaagcgattctcaagcctcagccttccgagtagctgggattacaggtgcgccaccacgcccagcaaattttttgttttgttttgttttgttttgttttttagagacagagttttgctcttgtagctcaggctagagtacaatggcgtgatcttggctcactgcaacctccgcctcccaggttcaggcgattcttctgcctcagcctcctgcgtagctgggattacaggcacgtgccaccacacctggctaatttttgtattttttagtagagatggggtttcgccatgttggccaggctggtcttgaactcctgacctcaggtgatccacccgccttggccttccaaagtgctgggattacaggtgtgagccaccacacctggctagaggtgtgtcctttttaatgctcatctttaagtctacctcagatttaatgaattaggacctctagggtaagccccgcttggggcatttgtacctagatccccaggcaattcttacatatacgaaaagtatgaaccgccacgaggaggcctacacactgcacaagaggcaatgtggcgtggtcagtgctgggaggatggcacctccttgagagactggggcacagaggtgggacctacaccctggggtggggatcgaagaggcttcctggccaggtgcggtggctcctgcctataatcccagcactttgggaggctgaggcaggggggcagcgactgcttgagaccaggagttcgagcccagctgaataggatgcccggctactcccaccttgttttaccatagtgaaccaacggtttttccaataggggcaattttgctgcccagcggatgtttggcaacgtctgcaggcatgctttggttgtcacaactgagggatgctatgggcatctagcgggcagaggccagggatcctgctaaatgcgctgccatatacaggacagccctcaccatgcagaacaaccagcaccaaacgccaagagtgctgcaattgagaaatcctggtttcgatggtcccacttcctttaagaagcctccatttttttttttttttttttttttttttttatgagacaggatcttgctctgtcacccaggctggagtgcagtggcacaatcatagcttactgcagcctccacctcctaggttcaagcaatcctcctgtctcagactcccgagtagctgggactgcaggtgcgtgccaccatgctcaactaatttttaaattttttgtagagacggagttttgttatgttgcccaggctggtctcgaactcctggcctcaagtgatcatcccaccttggtctcccaatgtgctggtattacctgcatgagccactgcaccaggctgaggttgagaattttttttttttttttttgggatggagtctctctctgttgcccaggctggagtgcagtgctgcgatcttggctcactgcagcctctgcctcccaggttcaagtgattctcctgcctcagccttccaagtagctgggactacagaaccactacacccagataatttttgtatttttagttgagatggggttttaccatgtttagtagagaccaggccaggctggtctcgaaatcctgacctcaggtgatctgcccacctcagcctcccaaagtgctgggattacaggtgtgagccaccacaccgggctggtgttgagattttatctagacctggcagccctctccttcaccagtaactcctaaaaccagggacccctggaggggaggccacctctccttccctgccccgccctggtcccaggcttagcctctccccctgttcacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggaggtcagcattggccgggcaagggctgggggtggcctgtccagggacacccagggcagggatgtctgggactgaagcctcacccctgctctctgccctcccagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggacttcttatatcgtttttgtctctaaaaagaaacttttattatgaaagtaatacatgcccactttcctatatatagacagcataaagaaggtatgtcagcagatttctcccttttttgtttgtttgtttgtttgtttgtttgttttgacagagtctcactctgtcacctaggctggagtgcaatggcgtgatcttggctcactgcaacctccacttcccggttcaagcaattctcctgcctcagcctcccgagtagctgggattacaggtggtcactaccatgtctggctaatttttatatttttagtacagacgacattttgccatgttggccaggctggtctcaaactcatgacctcaggtgatccgcccaccttggcctcccaaagtgctgagattacaggtgtgagccactgtacctggcctctgccatctttgaggccttacgtattcattcattcatgcattcattgtttgggacaatctgtaaacaatcatgttggacattctttccagcatgaaagttttcagagaagtggaaagaattgtgcagtgaatcatcctgagtatgcgccaccctgttctatgttaacattttgttacagttgttttatcatgtagtccagcccccatcaaatctatgtattcactgttccatcagtgagtagatagagctaatgaatggcagggttggcacctgaggcattttattttattatttttttttatttttagagacagggttgcactctgtcacccaggctgaagtacagtggcacagtcatggctcactgtagccttgacctcctagactcaaacaatcctcacaccttggcctcccaagcagctgggactgcaagtgcatgccaccaagcccagctaatttttttttttttttttgtagagacgcgatcttcctatgttacccaggctggtcttgaactcttgagctcaagcagtcctgccttggcctcccaaagtactgagattacaagcatgagccactgctcctggcatcctgttatttaggtacagtttttatacacagtaaaatgtataaattgttacatatttttacagtaaactgagtctgggccaggcactgtggctcacacctgtaatcccagcactttgggaggctgaggcgggcagatcacctgaggtcaggagtttgagaccagcctgcacaacgtgacaaaaccccgtctctacgaaaaatataaaaaattagccaggtgtggtggcttgcacctgtagtcccagctacttggaaggctgaggcgcaagaattgcttgaacccaggaggcggaggttgtggtgagctgaaattgcaccactgcactccagcctgggcaacagagcaagactctgtctcaaaaaaaaaaacaaaaaaactgagtctgacttagtgtttctcatacttcattgttaccctttctactatatttgccatatctgaacctaacagtacttttatttacttaatatttttcattaaagcaactaacctttaatatacattcagttattttaaagggaaacattattaaaatcatgagtttgaggtgatatatatgtattttctactttactttaaatagttatgtaactattggagtttaaaatgaacatgcaagttccccctgagactactccattacgaccagtgatgtttgtggacccagatctaggaaatgctgacccactggttaatagcatgggctttgggggcagaaggaactgactttcaggtgccaaccctgccattcactagctctattaccttgggcaagtcacttcacctctctgcacctcagtttcctgatctgtccaatgggataatagtagcaccagcatttcataagttgcttttggaaactacatgagatcatgtcaacactcaataaacatcagctctgatcatgctatgatatgactcctgcctctcacctttgcattgcattatacccgtgtttctcaaaccttagtgtgtactgga

SEQ ID NO: 14466 - DNA, 8283 bp, Human
ttagccgggcatggtggcgcattcctgtagtcacaggtaccttggaagctgaggtgggaggatcacttgtgcccaggaggttgaagctacagtgagctatgatcacgccactgcactccagcctgggtgacagagtgagatcctgtctcaaaaaaagaaaaagtaaaaaataaaataaaaaaaatatatgtatatgaaaaaaattggaaagttgctgacaatcattcatacaatgttagacctaaaggtgaccttagagacctgtatggtgataagaaatagagcaccagaggcagggagccattgggttggctccaggctgctgcaggattcctgcctccatcaaaggtggtgcttagaccagatttttttttttttttgacagggttttgctctgttgcccaggctggagtgcagtggcaggatcttggtttgctgcaaccttgacctcccaggctcaggtgatcctcccacctcagcctcccgagtagctgggacagcaggtgcgcaccactgtgcccagctaatttttgtgttttttgtagagactggattttgccacgttgcccagggtggcctcaaactcctgagctcaagcaatccacctgccttggcttcccaaagtgctaggactacaggcgtgagccactgcacctggccagactaaatgattttaaggcctaagattctgatgctgtgatttcatagaattgccctaattggaataggaaagtggggctggggaggggagaaggagggtatggggaagagaagtagagcaaggtcactttatgtagttccaaataaggaatcatacccttaccttcttctaggtggaaagcggcatcctgcattctcttcttgtccttggcctcatctctgctatgggctgtgccacctctatatgctctttctcaccaccaggccttcagaatgcagttggaaatgtgccctctcgtctgggtgtggtggctcatgcctgtcatcccagcactttgggaggccaaggtgggcagatcacctgaggtcaggagttcgaaaccagcctggctaacatggtgaaaccctgtctctactaaagatacaaaaattaaccaggtgtggtggcacgcacctgtaatcccagctactcgggaggctgaggcaggagaatcacttgaacccaggaggcagaggttgcagtgagctgagactgcgccactacactccagcctgggtgacagagtgagactgtctcaaaaaaaaaaagaaaagaaaagaaaagaaatgtgccctctctagtgtgcctcccaggtcactcagctgatggaaaatggaatcctactaacgtgcagggctctagaaattcagcagcgtttcatacatggcatctgccatcaaggaagtcacaggaaggtgggaggcagacacagatatccacaatataaagtttagccaagttcttttttgcaagcctaatcataggtgaggggatgcaccccagagccaccaatccggccccttccgcccctgggggaagcattaatgacgccgaaatgtgtcagagctcccaccagccccctcttcactgctactctttcttcccaggcaaaacaggaaccacaaaccccagcttcctcttgcagagtggctgtggcttgtaggggaggcagaaatggctgaggtgcggatacgagacctgagtcacttgagctgctgttgccacatgtcccctccctctccccctccccagttctaaggtctcctgctcccactttgtcctttctggcctcttgcttgtcctttatttccaaatgtgcacctgagtcccctgtgtgatgtacacccatttcccgggctgcagtgggggctactgtgggcatcaggggccgtgggcagggcctggggtggggacgcatcagggagacaggggaagaggaagtgcctttggtcctggggaaggttggcttgtcttggtgggtggggacggtcattatcagctttctggacacacagacagagacagacaggatggacttcctccggctatacctccctgggctgcaccaggccttgaggggggcactggtgagaagggcagacagctgccagatacttgcaccccattccctggggcctcacttccgggcacctcccctggggcctcacctttcccctcctccttctgatctcctcaaactggagattgctttctcaggttcaggcagactcctggcctaatattttctgaatttcagtccccacctccaaccatgcgtcctcgtacccctaatcgatgccccttctggctccttctgcaaatcctcttcttctcctttcagatcccagtaccctcttccttaacctgggctcctccagccagggcccccagggaaagggctgggactctcctcaatgactctcccctctctctctcttttttcctaggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagaagagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccaaggacctgagctgatggggggcgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcacgggcctgacttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcgaccattttccttacaggccttcctctctaactcccacttcccagcccaactccctgcaccaagaccctcagaactgggcggggataacacaaacctctggagctgcatccaggccaaaggaaggcggttgggagggcttaaggagcactgttcagaatcagagatgagctgccttgagcttccaacacggtagctcggcctcaggatgctgctggttactatggcaactgcctgccggagcaggacatagtaggggaaggtgggccagagaccccaaaaatgtaggagcagagaggggttcaggatggctagaggttgctgaccccgttccaggctgccctgccctctgggtgtcagacagcccttacccgaagagaagcggaggccaggggtggatgagagtgctttattgggcacccagcatgggggcttggcccgaggaggaccatcgggccccaagacaataaataaaccatcatctccctaaacaataaataaatatccaagaaataaatagctggcgaggaccagaggggctttcagttactgggtagagcctggggcagggggctggaagagccctcccttgtccaaggctgatgatgcgaaggctgccctgatgccaagactccagtcctaaagttctaaagggtggggggcagggggctaagaagccaccgatcagggctgggggctcaatgttgggaaccccaagggccagactgagtgcccagccttggacagcagcagcaactcccgcacggcccgagataagacgagctccaaggagtgcagcaggcggtaggtggagaggagctggggccaggacacctgggccgggccctgtaaggcgctgcccagtgcccctgggagcagccccttcctctcctcctcctcctcctcctcttcctcctcctcctcctccgggaggttgaatcctgcagccagcacctgtgaggagaggccatgggtcagggaggggccaggccgagaacctgagaggaatcctcattccctattcatgcccagcggttcccaatgacatcagtgaccacaaggtcatgatttccccggacattccctgcttgatcttccatgatgtcacctgctaacgcgtctcacctgatctttcagttcgagaaaatggaagtcaaggagcaagaggatgctcacagagctagatcaccccaaggactgccccgaggcgtggggttcaggaagtttctctctgctgtgaaagttgcttttgggtcgggtcagcaacaggcagagggtgacatagctcagattccctgctgcttgccattcctctctctctctctttcttgggagccccgctctgtcgcccaggctggagtgcagtggggtgatcacggctcactgcaacctctgtctccccagttcaagcaattctcctacctcagcctcctgagtagctgggactacagacgcgcaccaccacgcccgactaatttttgtatttttagtagagatggggttttaccatgttggccaggctggtctcgaactcctgacctcaaatgatccacccgctttggcctcctaaagtgctgggattccaggcgtgagccaccacgcccagccctgctgcttgcattttctattctcatttcattaagtgtaaaattctgatttccctttgaaaggttctggaggatctgggtgacatcagagaatcagagggagaaaggaaacaggaggcagacgctgtgctgggcactcaggacacaccccgagtgacctcacagcccaatggcctcctgttgaagatagagccccaggagaatgtgaagattgaggggcagcaccagggcctggtgtggctgtgtgtgcgcctgcacacacgcacacactcacacacatactcattctcacaacgcacccacactcattcccatacagtcacattcacacaaaacacattcatggctgggcacagtggctcacgcctgtaatcccagcac

SEQ ID NO: 14467 - DNA, 7845 bp, Human
gccaccacgcctggctaattttttgtatttttggtagagacggggtttcactgtgttagccaggatagtctcgatctcctgacctcatgatccgcctgccttggcctccaaaagtgttgggattacaggtgtaagccaccacacccggccttaaaattgttaattttatgcaatgtgaattttactgtatttaaaaaaatcaattttagtaatcccaacactttgggagggtgagggagcaggcagatggcttgagcccaggagtttgaaaccagcctgggcaacacagggaaacctcatgtctacaaaaaattagttaggcatggaggtgtacacctgtagtcccagctactcaggaggctgaggtgggagaatcacttgagcccaggaggtagagattgcagtgagccatgatggcgtcactgcaccccagcctgggcaacagagcaagaccctgtcctaaaaaaaatccggccgggtgcagtggctcacgcctacaatcccagcactttgggaggccgaggtggatggaacagaaggtcaggatatcgagaccatcctggctaacatggtgaaaccccctctctactaaaaatacaaaaaattagccaggtgtggtggcacgtgcctgtagtctcagctactcggaaggctgaggcaggaggatcgctggaaccccaggagacggaggttgcagtgagtcgagatcgcgccactgcactctagcctgggcaacagagggagactctgtctcaaaaaaaaaaaaaaaaaaaaaggaaaaaaaaattaaaaaaaaaaagaaaaaaaagaaaaggagtcacccgttctccactgttacttcaaattgtccaagcagtgagtgtaaatgatagaaaaagttggagtgaaaaggaataccaaactgatattacaaagagctacttccccaaattctccaaatgcaggaaagtgctgacaacagccagctgtatttgagggatctttgtcatcacctgccaaccttttccgggtttatctttgaagactaaacatctccctgtacacagtttatgtttagacgggaaccaaataacagattattatttactgagggcctgtgatgtcccacgcactgcggaagcaagcactcaacaagcatttcacgtatcctaaagacagcccagtagcgtaggcctattatccccattttgcagaagaggaaactgaggctcaacagagggaatgcctcaagtaatgggtggggcaggagctgaaccaggcaacgtggctcccagtcccacactgtccttatctcttcctacctgggctgtcgtttttctgacccgaggctactgtaatggctctatttacctgctggcccttgagtctgagacccttggggtgcatggtggggccacgcccctccactgtctataagccaggaaagctgagcactcaatatgaaccaagcctcatctcaattctcacagccgcactacagggtggtcgttccatcactcccgacttacgaggaaactgatacgctgatgcctctaaggcgcaaaaggcgtcgaacctggaccacgctcacagagcaagcaaaacacgacgccacaggtatctccgccccgccccagcccttttataggcgagccctacgggtcgcgtacagggccacgcctagacgctatttttgggtccactccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtagagggtcgcgggctgggcggccagcagagtcagggagagggggcgtggccaagcggtcgaggcgaggcgcgctttaggaggaagggggaggaatccgtgcttgggagcgcgggggcggagctagaaagagatggacagatggggcggggacggtgtgtgggagcggaaggggagggagtaatgaagcaggcggggctagagtaagagatccagagggggcggggccatcgataagtatagggagcctctgagaggacaggactctggctggtgggcgtggcgatagtgctgataggtcaactgcgggggcgttgcccacacaggcctttctcgggggttagactaaggaaaaaggctgggcctatcctctttcggaggcggagccaaccaggggcgtggtcaggtaaacgtccattaagtacttttggtaggtgcgtggtcagctgaaagtatggaccccaagctgtcatatcaatgagggtggaggcaaggggcgcagccactgggacaggttggggcgggtgtgggtgtgccgccgttcaggtaagcccttggtggtctgtattgatcagtgttggttcagccgtagccctcttcggcaggcgcccttggcctaccgctagccctccacccgctcttacctgccccccaggtgatcggaggtgctggactggacgtggacttcacgctggagagccctcagggcgtgctgttggtcagcgagtcccgcaaggctgatggggtacacacgtgagttcagtcttgatgcctgcctgggttcagttacagccctgcccttcccaggcggcctcaggttaccgccctgactgccccgctgagtcggctggctggccaccctgggtcatgtctgtgtgtctgtctgcccagggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggtgtgtccaggctgcgctggggccactccttccagatctctaggattcacctggggtgccccccttgggctgacccagcctcccctccgtagttgtgccctccaactgaattatagtaagagtagcagctcttaaaataagtagttcatttcaggccgggcacggtggctcacgcctgtaatcccagcactttgggaggctgaggcgggtggatcacctgaggtcaggagttttgagaccagcctggccaacatggtgaaaccccgtctctactaaaaatacaaaaattagccgggtgtggtggcgggcgtctgttatcccagctactcaggaggctgaggccagagaatgacttgaacccaggaggtggaagttgaacctgggaggcagaggttgcagtgagccgagatcgcaccattgcactccagcctgggcaataagagcaaaactccgtctcaaaaaaaaaaaaaaaaaaaaaagtagttcatttctaggtataaaccctggtgtaaaggtttaaggaactcatatcataaataactcataccgtaaatctccaaaccaccttgtgaagcagaccctgtgctcaagtcatccccattttacaggtggagaaagtgagatacaagatggctgagcaactcacggccacacagaccaactagcagagttggtattgaacccatgctggtttcagcaactatgctcttaaccacaagcaaatatgttctgtacatttattagtattttaattaactacttatttatttattttctaacagatctctcttggtcacccaggctggattgcagtggcacgatctcagctcactgcaacctctgcctcccaggttcagccaattctcctgcctcagcctcctgaatagctgtgccaccacgcctgactgactaatttttgtatttttagtagagacagggtttcaccatgttggccaggctggtctcgaactcctgacctcaggggatctgtctgccttggcttcccaaagctctgggattacaggtgtgagctacggcgaggcaaggtcttgctgtgtcactcaggctggagtgcagtggtgtgatcatagcccattgcagcctcaaactcctgggctcaagcaatcctgccacctcagtgggactacgggtgtgcaccaccatgcctaattttttgttttctgtagagacgaggtttcaccatgttggctagggtggtcttgaactcctgggtttaagtgatcctcctgtgtttggattacaggtgtaatcttgcttcagcctcctgagtagctgggattgcagttgcacatcaccacccctggctaattttttgtagagatggggttttgccatgtagcccaggctggtctcaaactcctgggctcaagcgatcctcccacctcagccttccaaagtgctaggattataggcatgagccaccatgctcatccttgtacatttatttaggcattaaatgttcacagcaatttggaagcttatagaagaggaaacaggctcagataggttaattaagttgctcatggtcacagccagtgagtggcagggtgaggatttgaacttagcctgaacaagtctgtgtttgcagctgtacctcccagggttaatacagcctccctccgtatcccccggtttttttggtctctgctccctgatgggtggagggaggcctgacccttcccctcccgctgccctgtaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatcacaagagcctgctgattggggctcagggacaccagccaggacagaccggcccccgagggggcagccagacaggtgggaggggcctcccacgaagctcagaagaaaggtcgtgcgggagccgatggaggtggtcgcctggcacaagagaaaaatcagaaagcaaagtttaactgagccccagttgggccacgaggcttgggcttccccacgaggtgagagaagcagggcctgagggtaggaagggggtggagcgctggggtccccgcttcaccaggcagcagccaggcctgtgcacgtgggggtgtgcagggggtcagagaatatctgctcccactcctcacatgctaaggaaagtaaaagctctcccctgtatcgagtggcttcctctgaaaggtgacacccccgaaagcagagccctcagggagatgggaggcacttatgagtgcagggacttgggcatccttatgggaggcctgatggaggtggcacccatgtccccagcctgaacactaacacaagaggcccacacagcagccaccagcagcgtcttccctttattttagtttattaatagaatacagagtgcaggcacttacagtggtcaaactgagcgaggagtgggtgaggtctcctcagagagaggccgccctgggcccacccatcagggaggcatgggcgggagctgagaggcccccaagaccccccgccaccaccacccacatagcccaagcccagccaccctgggggacccaggaggaggaggaggagaggaatagggcaaggccggcccgggccaacggctccgggcctagcaaaggcacctctggcagccgaggctgggccaggctcaggctgtgtggttaatatggccgggaaggactatgtacacctcaggcctgccagctgggcactaccgagcccactgggccaggcttgccgctggggagctcctgctaatgggaagttgatatacccctgcaccccagcaaggcctggggatgtaggcgcccttggtgcccgcacttatagaaggcctgccctacatgggctttcccagcccaagaagaccttggtagagtcccccccaggctggacccctcattcaggatggtgtcaagggttctggtcccccctctgccaccctgagactccatcccccaaagtgcaacaccccagcgccccctgcctggagctccagggcccctttgcgcagtgcggtgtccagccaggcacaggggccggccctggaccggggccagcgttaaggaagaggccagggctgcccactgggagcctggtcccagcataggggcggcggagggccccagaccactgaagctcctgcgccgcgggtgcgtgaggcccccccgagagcacgcccccctcgaggcctagtcgagcagggatggctcggctgggcggataatggtgggccggctgggcgcagcagggggtcttctgctgcaaagagaataaagacaggtggggagggggagacggcagtgaggccgggagcaagaggcaggcctgggttgaggacccagcccccacccacacaccaccccagggtgttcccaggctgacctccgcaagccaccagggtgtcgggcaggagtgccaaacctaggcatcaactcgcctgctgtttgaccctcagtgagccccctgccctccctgggcctcagcttccccaccggagaagtggggagaataaagcctggcccacggtaggttgaggcaggcaggagcaggaaggagaagaaggtaaacagtgggaggaggtgcccagtgtgagggttccccagctgcctggtggcacaccccagtaggcagagggcaagctgggagccccggagtcaccagggctccgctactctgtgacactgaacaagcctcttggcctctctgggcctgtttcctcgcaagccaaatagggatgaggacgattcctccactccagcagctgggcacgtagtgagagctcactgggaggaagtgagacagg

SEQ ID NO: 14468 - DNA, 11606 bp, Human
cctgtaatcccagcacttcgggaggccgaggtgggcagatcgcctaaggtcaggagttcaagaccagcctggccaacaaggtgaaatgctgtctctactaaaaatacaaaaattagccaagcgtggtggcgggggcctgtaatctcagctactcaggaggctgaggcaggagaattgcttgaatctgggaggaggaggttgcagtgagacgagattgcgccattgcactccagcctgacagagcaagactcagtctcaaaaaaaaaaaaaaaaaaaagatgctggctgggcatgcctttaatcccagcacgctgggaagctgaggcaggaggatggactgagcccaggagtttgtgaccaccttgggcaacatagtgagacctcgacttagtttttaaaaaatgatccgaccgggtgtggtggctcacacctgtcatcccagaactttgggaggccaaggcaggtggatcacctgaagtcaggagtttgagaccagcctggccaacatggtgaaaccccatctctactaaacataccaaaatcggccaggcacagtggctcacacctataagcctagcactttgggaggccaaggcaggcacatcacctgaggtcaggagttcgaaaccagcctggccaacgtggtgaatccctatctctactaaaaatacaaaaattagctgggtgtggtggcgcgtgcctgtaatcccagctacctaggaggctgagacaggagaatcgctggaacccaggaggcggaggctgcagtgagccaagaccgcatcactgcactccagcttgggtgacacagtgagactccgtctcaaaaacaaaaacaaaaataaaaattagccaggcgtggtggtgggagcctgtaatcccagctactcaggaggctgaggcatgagaattgcttgaattcaggaggcggaggttgcagtgagccgagactgcccggtggggcctgaagatcctgggcctggctcggggtgcacctgggggacaggcatagccattggaggagggagagagctgggagtggagtggggcctgaagcctggcggccgccggtgacactaagtgggtgtgtgttgagggcctccctgcagtaaagctcctctccaacagtgtcagggtgccctgggcagggtttctgctcattccccagcgggccacccaggcctgcgtggagctgagggaagtgagccatgagccatcagccactttcccggaaggaccccggataagggacccacagcaggagatggggacagctgggtcacactctgcagcagccacgtgctccactgacagccggcatccggcccatgtagaaagctgacccaatctctcatgcaccctgcccctaaccagccaccgtcacagcaatgtatgcagtcttggccacaagcatcgcaggacacaaggcctcgggcagtcataccgctggccctggccccggccccacagccaggcctctagtccctgtatgtcctcagggccccacacataggaccggggttacagtgggccctaaaccacgtttcccaccccagttcactctccctacgggtctcctctactcacggaacccctctccctctctgaacccccatcccctccgctgccctccctgagaccctccccatagtaaccccccctcgctgatgagcccctctgcctctcccagagaccaccccctgctccagctgagctccatcccctcacatcccccctcggcccccggcccacaccctcccccgtcccacttcgccttcacccacgagggcctcagcgtcccgggacctgggtcgggggggtgactcgggtcgctcgtggggggccggctcgtttgcctctgggccgtggccgtgtctcttaaaacccgaaccggggcctgggcgactctggcctcgcggcccgagggttaacccgggcgcggcgcggcgcggggcggggccgggcgggacgtcggtcatccccgccggcctcgccccgcagccatggccgccggccccgcgccgccccccggccgcccccgggcgcagatgccgcatctgaggaaggtgcgaggcgggtgggtgtcccgccgtcccccgatttcccggcgcccgaggccgggaggggccggagagcatggggacacgggggcgcgcggggcggggcgggcctggggcggaggtctgcgaggccgggaggggcggcgaggcctggggcccttgggggtctccggggtctccccggccctccccggccctccccggcccgccccgcgtccccgccgccagctgcggcctggaatccgccgccgccgcgcgttaatctccgcgctcccggatccggggcatcccggccggtgccagggaatcagggttgcggggcggccagacaccccctgacgactccctccgcccagatggagcgggtggtcgtgagcatgcaggaccccgaccagggcgtgaagatgcggagccagcgcctgctggtcaccgtcattccccacgcggtgacaggtgaggcgcgccggggcgggggtgcgtgcgcgcctcggcctccctccacctctgtctctcccgtgcaggcagcgacgtcgtgcagtggttggcccagaagttctgcgtctcggaggagggtgagcgccctgcctcccactgggccctggggtcactgggctggtggcctaggcctgggttttcctggagtctggcagttctcagagccctgctgagcgcgctgtgcaagggtggggagcacataggggagaggaggcccggctcgtcccgccctcgcccgcttccgcggccccgcgctcaccgtcccacccctccccagaggccctgcacctgggcgccgtcctggtgcagcatggctacatctacccgctgcgcgacccccgtagcctcatgctccggccagacgagacgccctacaggttccaggtcaggctcgggggtgcaggtgggagccggtgggacccccacccccacccacccagcttaccaactcggggagacaggaggggcgccgagcttgctgggattggagtgggactccgccatgtcgccgtgggctggtggtccatcgccccctccccaaaagtcctggaccgcaagtacggatgtggtgagaaggacccggctgagggatggagcctcagttttcctggggaccacagcagggccccacaaggggtcgtatgtgcagaggattctgccatcttcctgggggtccctaggcccaggtcctgagggaggggctgtgaaggcctgaggacagcattcctgccctccctaaccacatcagggtcccgggccgacctgccgtcggttgtacccctccccaggcacagactgtgactacatccaagacttgtgcaggcccccagccccaccccgccttgaatgggggcttagggtgaccagtgagggaggcagtgtctgaacagggccctaaggagcgagttgacctcagttctagttggagagactggccagtggtcagtggagtctctgggtggtgggcaggcagggagatcctcagacacctcctgcccagcccaggcttcttcccagggaggtctgagggtggggtgacactggggaggcacagacgcaggcgtcctggacaccttctccctgcaccacgccagaccccgtacttctggacaagtaccctgaggccggctgcagagctggactatggtgagcaaggggacggctggccccagacaagttcccaggactgggggcctcagggtgatgccgtgaggcagggcagagctggcccctctgcaggctgtccctgttcttccagccatctacctggccaagaagaacatccgaaaacgggggaccctggtggactatgagaaggtgggaccccccacccttcccgccccggctgggtacagctggaggaacccaagcctcactcacggccccccggggcttcacggtttaccccagaacatacagcccaggccccaaaacccaagacagtccccaaccccccaactgcccacacagtctcactgggggcaggggccggggtgacccactggaaacctcgctgcccccaggactgctatgaccggctacacaagaagatcaaccacgcatgggacctggtgctgatgcaggcgagggagcagctgaggtgaggccccgccctgccccgccccgcctgcaggcgcccaacccaggctacccgggaagcccagcccaggccaggctccggtggccctgggaccgtggagggcacccctgggtgtggctgcctgcccaggtccaggcctgagggtgggggcggaggggctgctgtgtgcagggcgtgccctcaactcggcctcctcctcccagggcagccaagcagcgcagcaagggggacaggctggtcattgcgtgccaggagcagacctactggctggtgaacaggcccccggtgagcccacctgcggtgagggtgggggtcgctggccagcgcaggggtcagcgtgcttccctgacaggcgctctcaggaccaccattttgagcctgtggaaggacctgccttggagctcctggtgggggcaggacgttttcacttcgtgacttagttgcgtttctgccaatcagaacccaggtctccatccctagaccacaggacaagccagcttctctctgggcccaagggagagtcacagggatgccagattgcggggactgcagactctgcctcgggagcaggcagagtggggggcggccttggctgcagtggggggaccgagttcacaggccgggagcagctggggctgtggggaggcccggtggacaggccatttggaggtggtgagcagagaagagacagctgacggctaggtcgggactcttcccgagttcctttgagtgtcagtttccacatgggggtctgggagggggaacttagccttaaagggggtcagccaccggaactgcatccccacctcatctcgtctcccctccacagcccggggcccccgatgtgctggagcagggtccagggcggggatcctgcgctgccagccgtgtgctcatggtgagcccctgcgtgcgtgctggccgccctctcaccctgcacaccggctgcaccctgctggacgcaccatgggactgcccatctgtccgtcatttggtccacccagagggcacttggtgcagcctccccaagcccctgctcactcccggtcactccctgttccccaggcccctgctaactctcgctttctctcccctcccacctgctgccctgggtgcaggtaagtggagtggtggggacgagggggctggcggggaggaagggggctcttctccagaacagtatcagggtttgctgggaattggaggggtgacaagcagggttacggcctctgacagacctcagcagatccagcaacctccctccaggtggaggcctccagaaccagagggaccagaccagagggagcatctgagccccgcagcagcaaaaccctttgttcaaaccagtcccatccagacccaacatctggaaagatgcacctagaacctcactgataaaacttcttaagttcacgaccctaacatttccccatacaaagctggtcagagagagcggggacacaggccaggactcgcagcgcgtccgcctcctccgctctggccccagcgaggtgccgaccaatgaaggtcacacctggttccccagtgatccccattagtagtatttctcaagtatgtgttgtttaaaaacataatttaagtacatttgaaaatgtgacatattaggccgggcgcggtggctcacgtctctaatcccagcactttgggaggctgaggcgggcagatcacctgagttcaggagttcgagaccagctagatcaacatggagaaaccccgtctctattaaaaatacaaaattagctgggcttggtggcgcatgcctgtagtcccagctactggagaggctgaggcaggagaatagcttgaatccaggaggcggaggttgcggtgagccgagatcgcaccactgcactccagcctgggaaacaagagtgaaactgtctcaaaaaaataataaagaaaaaaaaatgacatattacagttgcaactttgagaacctgaggttccgtggaatattccacagatcgccagaccttaggcccccagaggtctcctcgaaagatccctgattggaagaaggggctccaaggggcgggactgggggcctgggccaccatctctgccagatctatggggcaggggctcagcctggggaggtgccctcctgctggggattttggaccccagcaggggacctgcatctaactgcagcccacctatccccttctagaccaagagtgcagatttccataagcgggaggtaagttctggagctgggagtggagggtgccaggtgccttccccagcccgggacctgactcacaggccccacatcctagatcgagtacttcaggaaagcgctgggcaggacccgagtgaagtcctccgtctgccttgaggcgtgagtggggtgaggggtggcagctggagacccctgctgagtgctgaggcccctcctgcaccagcccccatacccccttccaggtacctgagtttctgcggccagcgtggaccccacgatcccctcgtgtcggggtgcctgcccagcaatccctggatctcagacaatgacgcctactgggtcatgaatgcccccacgtgagcccaggcggggcagcgggactgcgggtgtgctcccagcctggggggacgcaggagggtcagtccccaccctccccaacagccctgccctctccccagggtggctgcccccacgaagctccgtgtggagagatggggcttcagcttccgggagctcctggaggaccccgtggggcgggcccacttcatggactttctgggaaaggagttcagtggtgagaaccccccagcccctgctccagtcccagcggggaggctgctgcctgggacccctcccgcctcggtttccaccagctccctgggaaccccccaccggccctggctgccactctcgatgggatccttgactgggtgcccggccccccaggagaaaacctcagcttctgggaggcatgtgaggagcttcgatatggagcgcaggcccaggtccccaccctggtggatgccgtgtacgagtaagtgctgcgtggtgggcaccggttggccaacgggcaggtgcacccagccgagactacccagtgctgtccccacccctaggcagttcctggcccccggagctgcccactgggtcaacatcgacagccggaccatggagcagaccctggaggggctgcgccagccccaccgctatgtcctggatgacgcccagctgcacatatacatgctcatgaagaaggtgggtgctgggccagcctgcaggggcaggaggggtcatcccagacgggcctccatgtccccaccctcaagggctctgtccgcacaggcactgcccacgttgactctgcccctggggagcaccttccccacctggttggggccgccctggccgctctcctgtcagtgttccgtcctgagcccactccgggttcagacaggctgaaggactggcccagatcacatgcttaataagggtcaagcttcgatctaaaaagttttgttttcttttgttttgaggcgagtctcgctctgtcgcccaggctggagtgcagtggcgggatctcggctcagtgcaagctccacctcccgggttcacgccatcctcctgcctcagcctcctgagtagctgggactacaggcgcccgccaccacgcccggctaattttttgtatttttagtagagacggggtttcaccgtgttacccaggacggtctcgatctcccaacctcatgatccacccgcatcagcctcccaaagtgctgggattacaggcgtgagccactctgcccggccgggatcacaggcgtgagccaccatgcgtggcctaccttgtttttttatttgactccacaaccctgccctcactctgtggggcacacggagccattcctggttcccgctaatggctgaggaggtgccgcggtttattcctctacacgtggccaccagggctcttgccattttttgctgcgacatggcccaggcagacgggagcccaggtctccctgcgtctgccttggtctgggcaggtccgaggcggctgcctccagcaccctgtccgccggagactctgtggctggaggaggctccagcaatgtttggctgctccttcgggtggagctggctgagaggtgaggaggcagaagggtcaggggctggacgctgtctcttgtaggactcctacccaaggttcctgaagtctgacatgtacaaggccctcctggcagaggctgggatcccgctggagatgaagagacggtgagcccaggcagtgccctgtggccggcggctgtggcctgggggctgctggggccctgcagtgaggtgggcaggacaccagctggccagcctgttctcagccgccttctcgcccacagcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgagcccatcctgctgtgggtgcagcttatggtgtgacggtgcatgtgacacatgcatgggtgtgtgtgcgtatgaggcatgtgtagcactgaggcacacgtgtggtgtgtatgtatagcgtgtgtgattgtgtgtagtgcacgtgtgcaggtgtactgaggcatgcatatgtggtgtgtgtgtgcacgtgtcgtgtgtatgaggcatgtgtagcactgaggcacaagtgtgtgtacgcatagcatgtgtgattgtgtgtagcgcccgtgtgcaggtgtactgtgaggcatgcatatgtggtgtgtgtgcgtgtgtatgaggcatgtgtagcactgaggcacacgtgtggtgtgtacgcatagcatgtgtgattgtgtgtagtgcacgtgtgcaggtgtactgtgaggcatgcatgtgtggtatgtgcatgtgtcgtgtaggatgcatgtgtagcactgaggcacacgtgtggtgtgtacgcatagcatgtgtgattgtgtgtagtgcacgtgtggtgtactgtgaggcatgtgtggtgtgtgcacgtgttgtgtgtatgaggcatgtgtagcactgaggcacacgtgtggtgtgtacgcatagcacgtgtgattgtgtgtagtgcacgtgtgcaggtgtactgtgaggcatgcatatgtgtgtgcacgtgtcgtatgaggcatgtgtagcactgaggcacacgtgtggtgtgtacgcatagcacgtgtgattgtgtgtagtgcacgtgtgcaggtgtactgtgaggcatgcatgtgtggtgtgtgtgcacgtgtcgtgtaggatgcatgtgtggtgcacattgcatgtatgaggtgtgcacatgtatagtacatatgtgtgaatgtattgtgcatgtgatgtgtgcagtgtgtggtgagggagggggcaggtcccaggtgtgtggagtcgatggtggaggagggacttgaccctctcagacccaggcagcagacttggggcatctggtctttgggaggagacagccagggcactgtgctctggtgggctagggtgagcagggtagtgtgtggggacgcctgccctccagagggggaacagtgaggaaactgttaaggaagcctctggggaggggcagttgtccccagcctgccctaaggccacagagctgcagagggcatggcatggcatggcccagactctctagggcccgcagtgaccacagggcaagaatcccttcttcacagtctgggggtgcaggctgttcctgcagggagggaaacttctgcccaccagcaatggcaccccttggcccagcccctcaactccggcttctcagggtggggctcatggccctgcccacccctccatggccaggggcacagctgctcctctgacctgcagggtgacccctccctttggggaccccctgccctccctcccgtgctgtcagggggcagctcttgcaaccccagtgaaccttcccttctccctccagccccaccctgcccgcctggcggttctcacttataggacgcgtccgcagagccctatggccctttcatacccaaggccttctgggctgagttacttttctcagggacaagagaaccgcttcctggcacgagggcacccacctgttcaacctcatcccccacgtccccctaccacgccttggaaggagcaatgggaacaaggttacacctgtgtggctctgaagcggggcttttcacacttgcatacatggccgtgggacagtcctgcagggctctctaaagcacctgcctgcccctcactgccgccacacccaaagctgcatctccgggaagcccctgcctgggctcctcttgcctgcagggtcaccagagctcaccccggccctaccatcatcccttcacgctggactccagccagccctcagacgtcacgcggtgccgaggccaccgtctgttccaggtgggagcacacccgcttgcatggggccagggtgcccagcttggtgggcaggggtcctcaaaccggaga

SEQ ID NO: 14469 - DNA, 58397 bp, Human
tccaaccattaccacagtcaacgttagaacattttcatcactccccttcaaaaaacccatgaatcgctccatatttcccctgaccccctggaagccctaggcagccactaatcattctgtctctatggatttgcctattctgggcatcttatataaatggaatcatatattagtgtgtcttcaagatggattcatgtgccgtacttcattcctttttatggctgaatagtattcccttaaacaaactataccatattcacccattcatcaattgatataccctaggattgcttccactttgggctattatgaataatattactaagaacacacatgtttttgtgtggacatatgctttcatttctcttggctatatatctaaaagggggatttgccgagtgttgtgttaactctaacctttcaggaactgccagcctgttttccatagcgagtgtagcctcttacattcccaccagcaggagagagattcccgtttctccacacccctgctgacgcttgtctttttgattacagccatcgtaggaggtgtgatgtggcatctatttgtagttttgatttgcatctccctaatgcctaataatgttgagcatttttaatttctgttttgcccaggctggtctggagttcctggcctctcagcgctggggtcacaggcgtaagcctctaccagttgagctgagcatcttctggtgcttattggccatttgcataatgcactggaaaaatattcatatcctttgtgcatttttcaattgtctttttattgttgagttgtaagtttcctccattctagatacaattcccttatcagatatgtaacttacaaatattttctcccgttctgtgggtggacttttaattttcttgatggtgtcctttaaagcaccgaagtttttgttttgttttgagatggagtctcgctctgtcgccaggccagagttcagtggcacgatctcggctcactgcaacctccgcctcccggcttcaagcgattctcctgcctcagcctcccgagtagctgggattagaagcaggcgccgccaaacccagctaatttttgtatttttagtagagagacggggttttaccatgttggccaggatggtctagatctcctgatctcatgatctgcccacctcggcctcccaaagtgctgggatttcaggcgtgagccaccgcgcccggccgcagtaaagtttttaatctgatgaagtttaatttattcttctgtagtcgctcctgcctttagtgtcactgcctcgcccaaggtctcaaagatctcctgtcggcttccaagtgttttttttttttttttttttttttgagacggagtctcgctctgtcgcctaggctgtagtgcagtggcgcaatctcggctcaccgcaagctccgcctcccgggttcaagcgattttcctgtctcagcctcccgagtagctgggattacaggcgcccgccaccacgcccggctaatttttttttttttttttgtagagacggggtttcaccatgttggccaggatggtctcgaactcctgacctcgtgattcacccgcctcggcctcccaaagtgctgggattacaggcgtgagccaccgcgcccggccttttttttttcttttttctttctttctttcttttttttttttttgatacggggtctcgtcgctctgtcgcccagggtggagtgcaatggcgtgatcttggctcaatgcaacctccgcctcccgggttcaagcgattctcctctaggattacgggcgcctgccaccacgcccggataatttcttctaatttttagtagagatggggtttcactatgttagctaggatggtctcgatctcctgacctcgtgatccgcccgcctcggcctcccaaaatgctgggattacaggcgtgagccaccgcgccccgcccaagtgttatttgtaaaacgaagaaaccaacatcgagagggacgctgactcgaccccgcgcctttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggttggtaactgtggcgctgctccctccaccaccacccctgtcctcctcaggccccctccgcctccacccctgccctcctcaggcccctccgcctccacccctgccctcctcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagtgagcgctgggcgggggcctggcgctcgcgggggccgcctcattccggggtcgcctcattccagggccgcctcgcggagcttagcttttgctgggcattcgagatctgctcgttgtagagtatttgaaaagtagaaaaaggaaaaaaaaaattaaaatcatgcattgttcaccacaccaaagcaactactgctgacatttcatcagtctccagcctttaaaaaataaagtaaaataaaataaaatgagtttgggatgtattcatcatgagaaaatacaaaattacacgaacaaggccggtggcggtaatcccagcactttgggaggccgaggcgggtggatcacctgaggtcaggagttcgagaccagcctggccaacatggttgaaactctgtctctactgaaaaaataaaaataaaaaaaaacaaattagccgagcgtggtggtgcgtgcccataatcctagctatttgggaggctgaggcaggagaattgcttgaacccgggaggcggaggtttcagtgaaccgagatcgcgccactggattccagcctgggcaacagagcaagactccgtctcaaaaaaaaaaaaaagttacgtgaacatctgaagttgtctttgccacccccagttccagcaagcacagggatcacccctggccgtgttgggagttgtctgccctgtgcatagatgcagatctatccacaggaaaagagaacgtcgcgtgaggtttttcatcgcacgaattgttctgtggcgcccttttcccatagtcggccttggagctccgtctgcctttgcaagcagggatcaacctcacccttggctgcaggctgctgccttcccctgtggacggcatgtaggttacttttgatttttcatcatcatgaatgttcagtttttgtttttattttatttattttttgagacggagtctcactctgtcgcccaggctggagttgagtggcgtgatctcggctcactgcagcctccacctcccgggctcaagggattctcctgcctcagcctcccaagtagctggggctacagggcatgtgccaccacaccctgcaattttttttttttttttttttttttttagtagagatggggttttgccatgttggccaggctgatctcgaactcctggcctcaaatgatctacctgcctcggcctcccaaagtactgggattacaggtgtgagccaccgcacccggactgttcagtttttattttggattttggtttaaaattatttttaaacttgttgatatggcagaaagttttaaagatacaaaggagtttagattatgaaaagaaagttctttcctactattggcccccagccctcagtttccatcataggggtaactactgttcccatttttctgtgtctttccaggaccttctgtgtcaatacaggcgtatgtatttcttttttctttttttttttttttgagacgagtcttgcagtcttgccaggctggagtgcagtggcgtgatctcggctcaccgcaacctccgaccccctgtcaagcaattctcctgcctcagcctcccgagtagctgggactacaggcatgcgccaccatgcccagctaatttttttttttatttttagtagagatggggtttcaccatgttggccaggctggtctccaactcctgaccttgtgatccgcccgccttggcctcccaaagtgctgggattacaggcgtgagccaccgcgcccagcctgcacttgtgttttttttctaagcacaagcaaagtcacaccatacacactgttctgcccctgttttcgttttcacttcatgtctgcatctttgatgtagatcagaacctgtcgagcacccttgtccttcttaccggccacggtgaattccatgagatgaacatattgtgatttgtttatcgtgtccttttggttgatggacgcaaaattgttttcaatcttttgctaatacgaaaagttcaaacgttctttccaggtattgtcattttgcagaattcttgtaatattaaatccccaaagtagcatggttgggtctaagggataaagagcatatttatttttaataggttagatttttcaatctttgttaatctggtaggtgaaaaattatatctggtagtaattttaatgtttatttgccttttaattgagatagaaagcatattttcctgtttttggagccatttggatttccttttcagtgaatgacttatttataacctttgcctaatgttctcttgggttgtttgattttttttccttatagatttgaaggagttctttatatatttaatgtaaaaataggtcttgggacaaagctatagtcaccctgtttgcttctgtgtagttcttgccagagttttgatttttgtggagttttcagtctaatctcttgtggtttctgagttttgttttaaatggaaaggcgttttgctctccaaaattattaacaacaacaataaaaaactcccttattttcctccagactgtttatgtcttttttttttttttttttttttgagacagagtctcactctgttgcccaggctggagtgcaatggcctgatcttggctcactgcaacctctgcttcccgggttcaagcgattctcctgtcccagcctcccgagtagctgggtttacaggtgcgtgccaccacgcctggctaatttttgtatttttagtagagatggggtttcaccatatcagccaggctggtcttgaactcctgacctcgtgatctgccttcctcggcatcccaaagtatgtcttgtttttaaatgtgtttgtcttggcataaggtgaaggctaatcctaagagctgatattttctgggctcttgtgaagagttgcagatgaactgcatggttgcctttggagccctgtggaactggagttataacaggccacaacgtggccaaatgatgattgattgggccaacataattttcttttccatatggctatctggtcccaacataattttattgaataattcaccttacttccactaattgattctgctgtctttatcgtgctaaattctcacgtttacttggatctattttttgtctttcttatctcctccaatgatctatgtgtaggttccataataattactgtgacttggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaataataataataattactgtgactttatgttatactatccgtaaggttagtcacttgtcgttacttttctttttcagcgttatcctggctgtgctttattatttttccctgtaaactttcgcatcaagtgcattaggtcccactcccaagctcttggtgtaggtagctttgaatctgttgattaactgggaagaaaaagcatctttatgttgaatcttcccgttcaggaaaatgatatgtcttcaattcatttttttctcccttattagcttttccattgttttcatgggccttttgcactcttcttagattcatcactaggtttttaaatttttttactccgggaaagtattattgtttgtgtatatgaaggctcttggtgtatgtacatttaaattttttttattttgcctatgctttttccaacctaattgtcatcccacactgtgagggggtgtgtgtgtgtgtgtacatgtgcataggggcctacctcactttattgtgttttctacaaattgaaagttcatggcaaacctgtgtccagcaagtctgtcagcaccatttttccaacagtatatactcactttgtgtctctgggtggtgttttggtaattcttgcagtatttcaaactttttcattattattgtatctgttacggtgatacatgatctttatgttactattgtgattgttttggggtaccaagaaccatgtccacataagatagcaagtttcatcaataattgtgtgtattctggctgttcgcccatctgtttccatctccttggaccaccctgttcccttagacacaacaatattgaaattaagctggttatctacagtggcctctaagggttcaagtgaaataaagaatcacatgtttctcacattaaatcaaaagctagaaatgattaggcttcttgaggaaggcatgttgaaagctgaactaggccaaaagctagtctgcttgcacaaaacagccaaatggtaaatgcaaaggaaaagctcttgaaggaaatgggaagtgttactccaagccaggcctgcacctgtactcccagctacctgggaactgtaggcaggaaaattgcttgagcccaggagtttaaatctagcctgggcaacatagggagaccctgactcttaaaacaaacaaacaaacaacgctaggcacagtggctcatgcctgtaatcctagcactttgggaagccgaggcgggcggatcacgaggtcagaagttcgagaccagcctggacaacatggtgaaaccccatctctgctaaaaaaaaaaatacaaaaattagctgggcgtgttggcccatgcctgtaatccccagctactcgggaggctgagacgggagaattgcttgagcctgggaggcagaggttgcagtgagctgagatccgacattgcactccagcctgggcaacaagagggagactctgtctcaaaacaaagcaaaacagaacagtgaatgcatgataaaaaggtaaatagctttgtttgttgctggtatggaaagttttagtggtctggatagatcaggccagccacaatattctcttaaaccaaagcctaatccagaaaaaggctctaactctctttaattctgagaaggctgagagaggtaaggaagctgcagaagaaaagttggaagctagcagaagttagttcatgagatttaaggaaagaaaccatctctataacgtaaaagtgcaaggtgggccgggtgcggtggctcacgcctgtaatcctagcactttgggaggccgaggtgggcggatcacgaggtcaggagatcaagaccatcctggctaacacagtgaaaccccatgtctactaaaaatacaaaaaattagccgggcatagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaaaaatacaatttgtaaggctatagctgccatagatagtgattccttggacagatcagggcaaaataaattgaaaaccttctggaaagcatgtgccattatagatgccattaagaacattggtgatcatgtcaaaatatcaacagtaacaggagtttggaaaaagttgattccagctctcatggatgactttgaaggagtcaaaacttcagtggaggaagtaactgcagatatggtggaaatagcaagagatctagaattagaagtagggcctaaagatgtgactgaaatgctgcagtctcacgataaaacttgaacggatgaggacttgattgttatggatgggcaaagaaagcagtttctgggctgagtgtggtgactcacgcctgtaatcccaacacttgggaggctgaggcaggtggatcacttgagcccgggagttcgagaccaacctgtgcaacatgacaaaaattcatctctattaaaaatacaaaaactagccggacatgggtgtcatatgcctgtagtcccagctactcaggggactgaggtaggaggatcacctgagccttgggaggtcaagactgtagtgaacggtgatcacaccaccgcactccagtctggatgacagagtgataccctgtctcaaaaaaaaaaaaaaagaaagaaagaaagtagcttctggaaatggaatgtattcctggtaaagatgttgtaaacattgttaaaatgacaacagagatttcgaatattatataaacttagttgataaagcagtggtacagtttgagagcattgcttccaattctgaaagaagttctgtggtggataaagtgctgtcaacgtcccgtacgacagagaaatctttcatgaaaggaagagtaaattgatagatgtagcagaggtcattgttgtcttattttaagaaattgctacagcaccccagccttcagcaagtaccactctaatcagtcaacagccatcaacattgaggcaatacctttctccagcaaaacgattgttttgctgaaggctgagctgattgttagcgttttttttttttttttttttttgagactgagtctcactctgtcacccaggctcaagtgcagtagcacaatcctcatcctcctgagtagctgggattacaggtgcccaccaccatgcccggctaattttttttttttttttttgagacggagtcttgccgtgtctcccaggctggagtacagtggcgcgatcttggctcactgcaagctctgcttcccgggttcacaccattctcttgcctcaccctccaaagtagctgggactacaggcacccaccaccacgcccggctaattttttgtatttttagtagagacggggtttcaccgtgttagccaggatggtcttgatctcctgatttcgtgatccacccgcctcggcctcccaaagtgctgggattacaggcgtgaaccaccgcgctcagccatgcccggctaatttttgtatttttagtagagacggggtttcgccatgttggccaggctggtttcgaactcctgacctcaggtgatccacccaccttggcctcctaaagggttgggattacaggcacgggccaccgtgccttatcactgtttttgaagataacataagatttgtcattttaatgatttgtaagtgtataattaagtggcattaattacattcattatagtgtgcagccattaccgctatctgtttctaaagctttttcagcacgtaaactgaaactctgtaaccactgaccaataactcttcatttcccctgctcccagcctgtgctaacctctaatctactttctgtcttgatgcatttgcctgttctagacatttcatatactgtaagtgcaccatttgttcttttgtctctggcttattcagcatgatgttgtcaaggttcacccatgttcattcctttttatgtctgagtaatattccatggtatggacagagcatgttttggaaaacatggctgttaacggttccataaccctcctgtgtgtggaaggaccctgttttcttagcccttcccctcttttcgccccgactcaggtaagccgcgtagcagatacgctgccagcaacacgggcgaccatgctgatgagcaggacggcgattccaggtaaaggctctgcggccacttcagggcggggcgtgtcctggtcccaggcctgggcaaagccccaccctcctattcacccagatgttttctccctgagaagtctggtgtttgtttttttccgtttagtgggtgctctcaggtagtgtagagtggaggactgcgtagacagtctggggcttgctgaataatttgggcacctgttccagcttcaggcttgtctggtgggtgaagcaggtcagagcacagatgaggccatgtccacgtgagatgtttatctcctatgaaagaaacatagaggaaagcagacccctatgttgttgtctttggatctaattccttgagcatgtacccagaggtcaaatgcaggtgcttgggtttagcacagcctggtcaagtcccttcttggtgtccaggctcaggtggtgatatgggcagtggggcttagagctgggatggtgtgaaccttgatgttctttgatgttcttttaggcacagatgaaaggtggatccggttccttcctgtgtttgtgcccctgctctctctgggaggcactaccagggtagaaactttagaaatgaccacttctgccttctgttcattttgaagcatagtaaatggtaacataggcccaggtgagggagggaagattgtgagttacctgccctgggttcccttaaacacagacaaggcctgtgtggagtaaaggacttggcttccactgtcccgggaaaaaatagctaagatccctatgctgggcctttgctgtgcagtgaggtagtgctgtttctctgcagttctctgacaaggcagcaccacacctgccatggcaatttgcaagtctttttaaaaaaattttattgattgattgtagagatggggtcttgctttgttgcccaggctggtcctgagctcctggcctcaagtgattttccttccttggcctcccaaatttttgggattacgtacataagccaccatgcctgaccacaatttgtggttccaagagtgtgatttttatcatcatttgggaggatgttggggcctctggcatgactgatgactgtctctgagtggagtgggctttggaagggcgatggggcttgctggacaccccattggaccgtcattttgatgtagaggcctgtggttgtcttgccctttaaatgtggtggtggaacaaactctggtttgtcacaggcatatagaatgcttttgcccctgcacagtgggtaggtatttcctgttctccctccacctgtgccacagatcagcttagagcagggctggctgctggccaccccccacattagccttactccaagctgcagtggatgtgaggcccaggctgctgaagactcagaaggaaggctggcagtacctaattcctgcagttaattttcagacttataatgacatgaccatgaggatattttctagggaattaatttaatatttaacgtaatgaagaggtaaaactgtgggaggggcatgcttctctctagaatcttttattgaagaattgcttcattcagtaattttagcacatcatatatctgtaaatctcactggtgccacccatgttttccagatacagggttcatacccttaggggctcagttcccctcctggtttattttgtcacgtaggcccgcaagcccctgctctgccttgtcatagctcagagcatgttcctggagcaaggcagtgaaagtgcatcaaatccactctctgtgtctttgatttttttttttttgagacggagtctcgctctgtcacccaggctggagtgcagtggcgcgatctcagctcactgcaggctccgcctcccgggttcacaccattctcctgcctcagcctccggagtagctgggactacaggcgactgccaccacgcccggctaattttttctatttttagtagagatggggtttcaccgtgttagccaggacggtctcgatctcctgaccttgtgatctaccagcctcggcctcccaaagtgctgggattacaggcgtgagccaccgcgcccggcccgtgtctttgactgttgttcccaaaagtgcttttctttctgaaaccagagcttcagtttaccagactgaaacagtattaacaggctacacagtgacttgtgagtggtcgtggcctgccttagaaaagtgaggacacagccgtgctgctcactattacaaacactggccagtgtggccatttaaattgaagttaactgaaataggccagatgtcgtggcttatgcctgtaatccaagcactttgggagtcccaggcagatggatcacctgaggtcaggagacagcctggccaacatggcaaaaccctacctctactaaaaatacaaaaatttgtcgggcatgggagcacatgcctgtaatcctagctactccggaggctaaggcaggagaatcacttgaacttgggaggcggaggttgcagtgagctgagatcacaccactgcactccagtttgggcaacagaacgagagtctgtctcaaaaaaaaaaaaaagaagaagaagatggaaattaactgaaataaaaaattcacttgcggccgggcgcagtggctcaagcctgtaatcccagccctttgggaggccaaggcgggcggatcatgaggtcaggagatcgagactcatcctggctaacacggtgaaaccccatctctactaaaaatacaaaaagttatccgggcgtggtggcgggcgcctgtagtcccagctacttgggaggctgaggcaggagaatggcgtgaacccgggaggcggagcttgcagtgagccaagattgtgccactgcactccagcctgggcaacagagtgagactccgtctcaaaaaaaaaaaaaaaaaattcacttgctcagttgcactggtcacatttcaggtgctcaatgtctatatggaaatagtgtctaccatattaaatggttcagatttggaatattcccatcacagtagaaagttcttttggggccgggagcggtagctcatgcctgtaatcccaccactttgggtgtccaaggcggggggatcacttgaggccagatgtttgagaacagtctggacagcatgacgaaaccccatctctacaaaaaatacaaaaattagctgggttggtgacctgcgcccttagtcccagccactgcggaggctgagggagcccaggacatggagcttgcagtgagccgagatcatgccgctgtactccagcctgagccttgagtgacagagtgagaccctgtctcaaaaaaaaaaaaaaaaaaaaaaaaattggacagtgctgtcttagagagggggctagttttttgaggtgcatcatcaagatatggttcagggctgggcgcattggcccatgcctgtaatcccagcactttgggagactgaggtaggcagatcgcttgagctccggagttcgagaccagcatgggtaatatgacgaagtcctgtctctaccaaaaatacaaaaaattagcctggcatggtggcacacgcctgtggtctcagctactcaggaggctgaggtgagaggattgcttgagcctgggaggcagagattgccacaagccaagatcacattgctgcactccaacttgggtgacagagtgagacccccctctcagaaacaatttaagatatgattcaggttatagagattaactcttatttattttttataatccttttctataattcaattatgagaaaagaaaatggatattgtccagtgtctctaagacttgaaaccaaggtcagaaaagatgtagtgttccctgggtattaggggccatggtgctcatgtttaaatgtaccgtgtgtccccaccactggtaggggcagaagccatcaagccaggtctgagagatagcctggtgtccctcagaaaggctggtgtgggcatgtccctctctgtgtggacaccgtcttcctgctcccttctttgaaactgcgagcagtgcttaggccactacctcagagaatggggagctagaggtttagagaagaactgatttctttcattttcaaaatgctctgaaatcatattattattattattattattaattattattattattattattttgagacgtagtttcattcttgttgcccaggctggggtgcaatggcacaatctcggctcactgcaacctctgcctcccaggttcaagcaattctcctgcctcagcctcccaaagtgctgggattacaggcgtgaaccactgcacccggcctaattttttttttttttttaacagagggtttctccatgttggccaggctggtctcgaactcagcttggtcaacatggagaaccctgacctcaggtgattgaactcctgggcttaagtgatcctcccaccttggcctcccaatgttctgggattacacgcatgagccccctcacccagctaccagctctgcctttaattctcaggtgacatcttggggaatcaggtggcactgctactgtcctcaggcttggccacttttgtagcagtgtacccaacttgtggctgcacttgggcctaggccagatggggtccttggccaggcaggcactctctagctcacaacatacaggtcctcccaccaggcacacatgaggctctgccagggcctctcttgttaggtttgcctctattagcttgtgtttttagagccctacactgatgtgttagaaagatgccctctcctttctgtagctgaggttgacacacaagaaagcaggtaggcatttttgtccccaggcttgggcacttccctctgcccagccatcgcatccatgctgcagggcagtgtaaagggacaagtgcaggttcagggttccaagtttgactctcgctttgcagccttcggtgtgtgatcttgggcacattctttagaatgagccttagttccactgttttctgttaagatgcctgagggtggtgagttgccttcacctcttcctcccagatcaggatgttgtaggaccatccttgtctctgagtgttagctgatggccctgcctccctcagaggggcagacgcaagtctgtaaaatgctcctgtcaggaaatggagcattgccggactcagaagccctctgtgcttactccttttcctctggagcaaaggggttgcattgtgacttgtctagttgtaggaggcagagcttacagtcaggcttcagcttcgaggattctgacttcttgggtgatcttgggaaaatccatgaaacatcttaatgctttcatactgtacaacctgaggagcttggcagctgctgaggaaagagatcccttctgtggatctttggcagagctcccacaatgtttccactcctggattcaggtctcctttctctttccagaatacatggaaagcagtgtgtcccagaactcaaatatctgcagaggaaaataaaggtttttttttttttttttttttgagacaaagtttcactctgtcgcccaaggctggagtgcagtggtgtgatctcggcttgctgcaacctcacctctagggttcaagcgattctcctgcctcagcctcccgagtagctgggattacaggcatccaccaccaaggtgagctaattttttctttttaagtagagacagggtttcgccatgttggccaggctggtctcgaactcctgacctcaagcgatccacccacctcggcctcccaaagtgctaggattacaggcgtgagccatcgtgcctagccagaaagtaaactcctaaactgtttctaaaaatctcaactcaggtagtgcaaaagcccagatgttttctgacaaatatatatggatccaccatgaccactttattgctccaggcagaggcttagggaagtcaggtgtgctggcagtcacagtatctcaagaattggagctggtgaaattcatatgacacgctatagttttcagaaggcttttgcctctgggagtcttatgtgatcctcggtaggcgatttcttgtcatgcagatgagaaaacttttaccacaaagattagttttaggctgggtgcagtggctcacgcctgtaatcccagtactttgggaggccgaggcaggaggattgcttgaccccaggagtatgagaccagcttgagtagcattgtgagaccctgtctcttttgaagaaaaaaaagaaaaaaggaaaaaaaaaaagaaaagaaaagatgagatacttctgcacaggcatccggctaatacatatggtgctgggtctgacccagctctgccagccttgtgcttacttctgaaaaatgacttttgttcctgcccagcctgtacttctgtgtgagaatttgacttttagtgagaaaaccccatggtaagcgttgagtgtggggagcgtgtgaccctgtttctcagcgtggggagtgtgtgaccctgtttctcactgttgggagtgtgtgatctgtttctcagcgtggggagtgtgtgatcctgtttctcagcgtggggagtgtgtgatctgtttctcagcgtggggagggtgtgaccctgtttctcagcgtggggagtgtgtgatcctgtttctcagcgtggggagtgtgtgatcctgtttctcagcgtggggagtgtgtgaccctgtttctcagcgtggggagtgtgtgaccctgtttctcagcgtggggagtgtgtgatcctgtttcttgtctggtaagttgcttagtcgtgatggtcaacagttaatgcttaatggtggcacttctgctagacttttgtgcagtttttataaaatagccttgtaacttttcatggtttttaaaaaagtgatatgtttttgtttggtcttgatggtcctgttcccatttcagcgagccatgtcctccaaccgatgagcaattggttgcagggtaagaccgagacctctccaccgtctttctgtcttgattccggctgccttctcttcttgtaattgtgcttaattcctgatttccctccatgttgaagagtgactgatgaggcacacaggcgtggacctcactgccccagttcccccatgaatgcccagacttcccaccaccccggctttttctctacccagtcatttagctatttcacattacctgagaggccaaggcatggctggctggcacccgggagacttctgggaccaggcatgtcacacaaacctcctcttcctccaggtaggcacaagtagtcctgtgagggtggtgggcaagcaggagtggactctgtcatctccctagtccactgccgccctagagagacctgtgactgttgctccttgtttttattttttgaggggttttgtgggggcctctcccaagggttgggcattaagtgtgatgctcaggcctagatgctattgagtgtgcttaatagaggcagaaatgttctcatggaattgatatggtgcttgtccaggagggcacggatgacgggcgactcttccattccccttgacagtgcatctcctctgggccttggaggtacacacagtgtctgtgagcttccagcaaggaggtgggtggggcgagcagagttgagctcccctccaggatgtctttccatccctttaggtgggtggggggagcagaactgagctcccttccaggatgtctttccatccctttttttgtccaagctagagagcaaaccctactccagaatagctcggcagtgatagaaggtcctggcctgttttctggctgggctggttcatcttcctaaatgtgtttttcttgaatttccaagttattccaggaatcttcagtttttgtaacagatgttttattgtgctgcagtacatttattaggcctttcaccatcaaaatgagggaaaaggattttcataaatgttggaagccaataaaacaaaacaacacttgtttatggttcagtttgctgtttataagttttgccccacccccaatctcatgaatataactctgtctttatgtgtattacattaccagacagactatataaagtataaagccagatgggtgcagtggctcatgcctgtcatcccagcactttgggaggccgaggtgggcagatcatgaggtcaggaggtcgagaccagcctggccaacgtggtgaaaccttgtctctactaaaaaatatgaaaaattagccgggcttggtggcacgcgcctgtaatcccagatatttgggaggctgaggcagtagaatcgcttgaacccaagaggcggaggtttcagtgagccgagattgcgccattacactccagcctgggcgacagagcaagactccatctcaagggggaaaagaaaaagccgctcaattgttttgtcatggggccgggcgtggtggctcacgcctgtaatcccagcactttgggaggccgaggcgggcggatcacctgaggtcaggagttcgagaccagcctgaccaacatggtgaaaccccgtctctactaaaaatacaaaaattagctgggcgtggtggcgggtgcctctaatcgcagctactcgggaggctgaggcaggagaattgcttgaactcgggaggcggaggttgcagtgagccgagattacgtcattgcactccagcctgggggacaagagcaagacttcgtctcaaaaagaaaaaaaagcgttttgtcattatatgtttgtaatattaaggtgtggggagtagatttctctgtgggccagatttgctcagataaacaatggctaactaccaccctgctggctgcctcagagggctccatgaacagccactaagtcaatgtgactgtttttttttttgagacggagtttcgctctgtcacccaggctggagtgcagtggcacgatctccgctcactgcaacctctgccgcccaggttcaagcgattctcctgcctcagcctcccgactagctgggactacaggcttcactgcgcccggctaatttttgtatttttagtagagacgggggtttcattatgttggccatgctggtctcgaactcctgacctcgggtgatccacccacttcagcctcccaaagtgctgggatgacaggtgtgagccaccacgcctggcccagtgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtgaggcgttggccctgggtcagttgctagagcagaagtgtttggtggcgttttaatacctcaaaccctccttcaacattaccatgtcccacagatgggagttatagaacagagtgagccatttagggtttttgaagaaagcatattatgcctgtggtgtaaggcacttgaatcctccatctctgcaggagagacctgcagtgggctgctgaggacttggctgtgggtcctgcgtttcccaggataactctaacaagattgatttcagaaggtccaactgcaacctgactgggttgagaggctatttccaaatggcacaaataggtttgaccaaaccctcgtatgtggtttgtttgtgagcctagggtgacttcggatggttagagggtcgtgccagttcaggaggaaggctggaaaacagtctgagccccacagcccatgatagacttggaaagaatcatgtagctacttgccatttgctattacagagctgagctacagtgcagttcaaagcaggccttcctttttcatcacaacatggaggagttatgtcagtctctcccatcccttcaccaagagggcctctggggaagaagcatgaccaggtttgcaccctagaatatctgtcctcagtggtctcttctaggaccttaggggtctccctgcccaggggcagagtatggccctgcggaggctagagcttccccaagagagtgcaccctcctgacctagatattagatatatttttcctgggtggagagatatgtatgggacttctctctcttctgggtccagatcagaggtagtacatttgtgtttctagagcggaggccctcagagccctggactctgagataagagtcagcaccacccacagcacccctgcaggtgacactcccttatccagatctccccaggcaggaggcatcagcattgccagtaaggagacagaagggcacagatgaccttgaaaaggggaaaagggatgccctccctcccacaccacagctgcacccacttctccgtggcacccagttgtgtgcaacctggtatttctgccatttggaaatagctgtgatcacagtgggcttgcacatcttgcacaaagcttcttccctgataaaaaccggaaagtttaagtgtttgggataagggaacggatgggcagccatgctatgaggaaggaagtcagcgctctgcacgcatccctgtgcactgtccccttgccctccacgcggctctttgggtgaagggccgctctgtgggtgaagggcctgggtcctgggagttgaaggtgcagcacagcaaacctgagtgtaactgggagaggcccctctgcctgtgaactttaaagagcagctccgcagggcagtgccggctccagctgatcctccctttgaaagcaaactgcaactgtttctctcctgaatttaatagagcatgccaaaaaatgacagcatgtgccttcagtctgtgcttctcatgccttttaccttgtaattctggtgatcttacatccataacctctgggattgctacagaagggcaactgttagtagcttccaccagcagtcggggcagagcaactccatgaaggtgcagtttactgagacccttccgctctggggccagcagggcatggtgctgtggtattttgttaacttatttttattctacctctcttaaattttaaggttttcagatgttattctggcaacaattttggcaaccaagtctgaaatgtgtggccaaaaatttgaactgaagattgataatgtgcgatttgttgggcacccaacactgctacagcatgctctggggcaggtatggctctccctgggcaggtggggctctccctgggcagatgtggctctccttgggcaggtgtggctctccttgggcaggtgtggctctccttgggcaggtgtggcttcccctgggcaggtgtggctctccttgggcaggtggggctccccctgggtagatttggcttcccctgggcagatgtggcttcccctgggcaggtacagaccctctgggaaggtgtggctccccctgggcaggtgtggcttcccctgggcagatgcgtctgtccttgggcaggtggggttctccctgggcatgcacagaccctctgggcagatgtggctctccctgggccggcaggcctggtccattctggctctggggggctcagaactgaggctgacaccagctctggtgaaggtactgggcaggagacctgattagacacttggtatgaactgtgcatcttcataaacccagagagtccagtagaaaaagagacaggtgttcttgcccctgaagacaggtgcttcagtccctgtccctagcttttacagtctgcattctaggtctctactgactgtggccctccccttcatatgtaggatgtctgtttccaggggaggccaagatagtgagttaactagcatcgtgaaacccttgaattttctacagtgtggtgcaagcatttcctcttatttattacaagacactctagtagctaatattagtattatttagcacttatttttctgctaaaccctctctatatgttctcttgatgaataggtgtcatagcactgaggaactcatcttgttagcaggatgaagggaacttgtacaccagagcctgccagtcagctctctgcatacaggcaggatcagtgatggcattactaagattctgaagggtcgaacacagtaacgtaggatttagctacatttatacagatccagcaattctgggaggttctgtggtgttattcgtgaacctccatggaaggagtttctgaggcggttgatgagcctggtcccctgtaccgcaccctcccttctcatcacagcctccacagctggggcacagtcccctacctgtaggcaatgaaggggagagttggcagcctgcccgcggtcacaccctgtagacaggagtggcagtcaggggtaggggatgggtgccagggcagcctggggccccaactccccctggtggcagaacttgtagttggctttgaagagttcccccgtgccccttggaatgcttcccttgagcgccctggtccttgtgaagctggctggatgccagaaccgggagcacagaaattaggacttgctggcctgcctcacctgggccctgctcagggcttggctgtccctgaacatcgtcctgtccctcaattgttctgagtatgcgtcatacttagcagatacagcctggtggatgcaggcgggcacgggaaggcagtgggggtgtgggtctgggtcctccacccatttatgcccctctccatctcgtcccctgtgggcattgtcagctcacttctgttagcgggggggcgagggggtcagagcactgaccttcccactcttgtcatagttgtgactttgcccatgcagtaggcacgcctccagagcaaaggcattcattgcttttccaagaccttggtgctgtattctggggacttttgccatgcctgaagtagaatagctctaaacagctttccttagaaagtcgtctcaattaattagaattatgcatcttttacagatctccaaaacagatccttccccgaagagggaagcacctactatgattctttttaatgtggtgtttgcactgagggtgagtgtttatataaatggttaagatcagggagtggggccagtggagaagcagctctttttttccaacgagcgtgtcattgactcggagcttggactgcagcgggctggcccctcctggggtgcaggcagactgcacttcattgtttacccctttttgttttggtaaaatacacataacactatttgtcattttgaagtctatgcttcagtggcatctggtacattcatgttgtataaccatcaccactatctagatccagaacactttcaccaccccagaaggaaaccccatacccattagcagttattctctttttttttttgagacagaatctcgctgtgtcacccaggctggagtgtagtagcgcaatcttggctcaatgcaacccctgcctcccaagctcaagtgagtctcctgcctcagcctcccgagtagctgggattacaggtgtgcgccaccacgcccagctaatttttgtatttttagtagagatcggtgggggggggggggtctcgccatgttggccatgctggtcttgaactcgtgaccttaggtgatccacccaccttggcctcccagactgctgggattacaggcgtgagccactgtgccctgcccctgctaatttttgtattttttgtagagatgagttttcaccttattgccctggctgatcttgaactcctggtctcaaatggtcttccctccttggccacccaaagtgctgggattccaggtgtgagccactatgcccagctggagcttaatttttaagacaggcctgccttgttgataaataaggaactacaaattaaaacaaaatgatttgttaatggctcctggggtacagggttctgggagaagttcttcactttctgcttgatacacttttgtagtatttgcattttcatagcatctttgtatttcttacataattacataatataaagcgccacaaagaaaaatgaattaagtaaaaaaacaagcaaaggagtaaacaaaatccatgacgaatgttgtccacctgtcaacaccgataacccctgtgggacagttgatgaaacgcagccacagccccacccaggatgctgtaggcaggccctcacctcggggaacagtgtttgcaggatgctgtaagcaggccctcacctcggggaatagtgtttccaggatgctgtaggcaggccctcacctcggggagtagtgtttgacagcatagcatatgatgcccttagatctagcagtcccactgttaggagtattatcaagaaaaacaagcaacttttacaactgcgtaaagatttcccccaggcttgttctcagcaagaataaagatttttataacaataattaaactggagataatcatagtgtgtagtagttggggagtgattaaacaatgtggtgattattatacactggcccatcctcttgccatcaagggtgagaaatggagatcagaccagaacctggagaagtatagattgattacggacaggtaaaagcaaccggagccgagcacaatggcttacgcctgtaatcccagcactttgggaggctgaagcgggcggatcacctgagatcaggagtttgagagcaggctgaccagcatggagataccccgtctctactaaaaaatacaaaattagccaggtgtggtggtggacacctgtaattccagctactcaggaggctgaggcagtagaatcggttgaatccgggaggcggaggttgcagtgagcagagatcgcaccattgcactccaatctgggcaacaagagcgaaactccagctcaaaaaaaaaaaaagcaacaggaaacaagatagtctaggacttcagctggccgtgatattgacgagtaggagaaattttgataatgtaaagagtttgtattttttgggtggacaagtctttctttttaaaatatatacttttgtcgttttaaatatatattctttctttttaaaatatacacttttgtcattttaaatatatattctttctttttaaaatatacacttttgtccaggcacagtggctcactcctgtattcctagcacttcgggaggccaaggtgggtggatcacttgagcccaggagtttgacaccagcctgggcaacatagcgaaaccccatctctacaaaaaatacaaaaattagccaggcatgatgatgtgcgcctgtagtcccagctacctgggaggctgaggtgggaggatcacctgagcctggaaggtcaaggtggcagtgagcagtgatcatctgctgcactccagcttgggcaagagagtgagaccctatcttaaaaaaaaaaagaaatacacttttttttttttactctgaaaaattttaaaccctgaactagagagagcagactgacaaaccttatatgcctgtctcaggtgcctttaaaccctggctccatatatttccttccctctctctatttcaaggcaagtcccagaccttatgtctgttcatccctacatacttcagaagatatctgtataaaatatgggcacttaattttcggccatgataccctttgtacatctgaaaaaatttgctgtaataagttggcatcacctagtacctggtccattgaagcttctcctgattgctaaagccttttcacagctggactgtctgaaccaggatgcaaacccagcccagctagtgcatgtggtgtctttatgtctctgccaatccagaggtctcccctccctttgttccatcaaatgttccacatttggattaatctcattgtgcagtcagacttgctctctgtccctgtgtttccttcaaactacaagttaactctgaaggcttggttctatttgggtacaagttttggggatgagaaagtctcatgcgtgatgccttaaacttcctgccactttatgtcgtgtatggtgaaaatatggtgtttctaaaagttcccattagtgctggcacaccctaggtgttagctttctcagcatgtccctcactccatgtcaggcctttgcaaaccggacatgctgggacaccccatgagtgcaggtcactgagcgtcactggggactgcaccactttgtatgtctggaaaggtcaagcatatgggccctggacatccaactcatggacactgttgtgcctcagctgaataatcacatatccaggatcattgtcctcctccttgctttgctcgtggaagtatttgtacacagattcttcttctaggtgggtattttgttttgaggcaattgtatacaccccatatgtcagccctctggtcccaaggacactgttgaggcaatgcccttgacatggaggagcaggtctgctgcccagtggtgggcacagcatgggagcaacagtcctttctctggcaagggatgctgccttgttgtaagtccatccaggtgtgagttctgtttgtgaacatgggatctgatgagaatatagagaatttcttcagctccagatgaagaacgtatttactgtctgggtcaggctttgcccctgaagcctggctgtgaacactttgggcatggccttccctctcagataaacaggagggggaggcagcaccagaggttgtaatcagcagtaccattcacccctttcccttgtcccacctccacccctacaggatgactcagcagtcctgttggcctccagaagcactgagtcatggttggcccagttatctgctctctcaagtgttttcacagacccccacagctgcatgcctccacccttggcttgggcagatgtgcttgcctggctgactgtggtccctgataggttccagagggtcgagggcccctcttgttcctgagagcctcctgcactgtcctttgacccagtcatcatggttgcagaaggagctcttgggcagagatatgggcctggagcctgctggttttcttgttaaccagtgtgacttctgctgggaagagcttctcatccttcaggaccaaaagtattcagtgaacaattggcctggtgcctctctttttgtaccgtgcatccctgtagtaacgtggcctgtcgtgactgaattcttacaaattgtagactggttctgcctaccagtagtcagcagtacagtggtgaccacagacactagcagggtctttgctcagggcaggttctgttcttagtttgttacatggctcgctaatttcttccattcagtccttggtgagggaggcaccattgttcttccttaagaacaacagtgcctccttagggcacccaggcatttccagagccatctctgttactattcaggcagccactcccaagaatagagcatgggggctgacagcccacatgtctatggatgggccctggaggggactcaggaaatgagcagcagtggcctctgcaaaggagcctgggggaaaggagtagagacgctttctttcatggtttgagtttttgctgtgtacctgtgttagctccatttaaactgtgtccagctgtgtccctgtgcacacgtttgagtctgtgtatggtctctctcctgcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggtgagtgcagcagggcgtgatgggcatgggtctgggctggctggtggcctctctgcagcgcagacctctgtggaggggctgtcattcagtgttaatgatacagatgttggcggggcctcacccaccccaacaccagcagagcagtcaggagcttgcaagcatcggcttttggtgagctgtgcattgaaaatgaagtcctcacaacagcttcgctaggcagtgtccatgatcatccccattttgcagatgtggaaactaaggctcagagaagttacatgatcttcacacggggctgattgtgcctggggggcacaggaagactcccaaggggcacatttgtagatgaattttcctggctggatgtgttgaaatagatttcccgaccagaaatgttctttcttcccacacactgctgcatgatcaccgttcacataggtgaggcagctctgcctagccctggtcctgttggagatgttgaagaaactattactccctggggcaggagagggcgttggaaatatccagctggtgaggtggacagtttccagttctttgctttcagccagattgaaggaggacctaattgggttatcaactaaccaattattaaaaataatttttgcagacagaacattgagtgttttttggcctactgtaaagatttcaaaacataaagagacacttgtaacaaactctccatctccattttctttggccagcacctctataacaaaagagagaattaggaacaaaactaaagtcagacctagttgttgtagcaataagtaaaattagttattgacatgaatgaacaataataaagaacagcctctctgactcaggtgcattttcagtacaaatttacctgtggctggctgcggtggctcatgcctgtaatcccagcacttagggaggctgaggcaggtagattgcttgagctcgggaattcaggatcagtgtgggcaacatggtgaaatcctgcctctaccgaaaaaaacccaaaaattagccgggcatggtcatatgtgcccgtagttccagctactcgggatgctgaggtgggagaatcacctgagccttgggaggtggaggttggggtgagctgagattgcaccactgcactccagcaagggtgacagagtgagaccctgtctcaaaaaaaaaataaataaataaaaataaaataaattttgacaggtaattgtcaaatatatagagtttttcttttgttttttccttttgtccacccaggctggagtgcagtggcgcaatctcggctcactgcaagctccatctcgcgggttcacgccattctcctgtctcagcctcccgagtagctgggactacaggcgcccgccaccacgcccggctaattttttgtatttttagtagggacggggttttcaccgtgttagccaggatggtcttgatctcctgaccttgtgatccgcctgcctcggcctcccaaagtgctgggattacaggtgtgagccaccgcgcccggttacctgtcaaaatttataatatgtttctgttttggccaattatatactaattataattgtgataataacaatccaaaagttttgtttttttaaacgttatctttttagagtctgtgactttatcacaggaagtaaaaagaaattttattttaagtctatgtatatatttttagaaatttatgaaaaaggatgaataaaagactttttggctggatgtggtagctcacacctgtaatcccagacaaaaaattttaaaattagcaggtctaggccaggcgtggtggctcatgcttataatcccagcagtttgggaggccaaggtggatggatcacttgaggacaggagttcgagaccagcctggccaacatggtgaatacctgtctctaccaaaaatacaaaaaaattagccagacatggtggcgggcgcctgtaatcccagctacttgggaggctgaggcaggagaatcgcttgaacccgggagctgtaaatcttgtgttgtgattcttgtaggaaatgaaggtcctcagtccccattccatcacatcctgcccaagtgcaagctggccagggacctcaaggaagcttatgacaggtaagacaggtgggtgtgcttattaacctccttcttatgggccagcctgcctgggcctgaggagcagcgtcaacaggtagggctccccggtactgaccactgttctcctggggtgtgagcatcagggttccctgaggttagggccggagaggactgggaagggatggtcatgtggctgctcttgaaagaagtgaccttggtggccgtttttttttgtttattttttatttctatttctatttatttcttttttttgagatggagttttgcttttgttgcccaggctagagtgcagcggcacgatctcggctcacagcaacctctgcctcctgggtttaagagattctcctgcctcagcctcccgagtagctgggattacaggcatgcgccaccacacccggctagttgtgtatttttagtagagacggggtttctgcatgttggtcagggtggtctcccgacttcaggtgatccacccgcctcggcctcccaaagtgttgggattactggcgtgagccaccgtgcccggccagtggctgttttttaaatggtttgctgagtagggtgcactctgctggaacttacatcacaaaagacaaatcactctcctatgtttaaggacttatatttcccaatagaagaatgaacaagggatctgagcagtgagctcacagaaaagacaggtggttcaaacatgtgaagagatgcatcagtgcatcacaataaagctacacagagatcccattccccacctgttatactggttaagatccacaatttcacgagactcgatgttggcaaagctcgggggaataggcatctcgtgtgttgctggtgggacagaggtacaaacccctgagtacctttgcttttttaaacccctttgctgagtagcatgcactctgctggaaccaccacctccagactcctcttaaaacagaaaacgagcccgaagttatacatgagagtccgaaagtgtttttaaatcaaacagatgcaaaatgccattttactgagcatgacgcaacaccaagtgctgggccaccttcactaggtgggtgtcactgactccagtcactcaagaggaaattgaggctcagtgggtgaggctggggccagctgtctcctctcactctgagagagttggggtttgcgacactgactgtgtgagggcagcaagccttgaggataccatgaaaacctcacagttgttctgattgtattggctgagcatcacctttattaaatgtggacaagcaggccgggcgtggtgactcacgcctgtaatcccagcactttgggaggctgaggggcggatttcttgaggtcagaagtgcaagatcagcctgaacaacaatgtgagatcgcatttctacaaaaaatttttaaaaaatatctgagtgtggtggcacaagtgtagtctcagctactcaggaggctgaggtgggagggtcacttaagcctaggaaatcaagattatggtgagccatggttgtaccattgtactctggccccagcaacagagccagaccgcgtatcaaaaatgaaaaaaaaaaggccgggcgcggtggctcacacctgtgatcccaacactttgccaggctgaggcgggtggagcacgaggtcaggagttcgagaccagcctggctaacatggtgaaacccgctgtctactaaaaatacaaaaaattagccgggcgtggtggtgcatgcctgtagtcccagctactcaggaggctgaggcagaagaatcacttaaatctaggaggcagaggttgcagtgagctgagatggcgccactgcactccagcctgggtgacagaactagatgtcatctcaaaaataataataataataaaaattaaaaaacaaaagtaaaataaaaaataaataaaatttaaaaaatactttttaattctttttttggctgcctagtgagccgcaactgcccccaccattgagtttgttccagccttccagtgctaaccatttacctgtgttattttgtatgtgcgcctctgtatctataagataaattcctaaaggcattactaatagggaaaatggcatttgtaatgttgtgtttccttctcgggggtttgtacctctgtcccaccagcaacacacgagatgcctcttcccccgagctttgccaacatcgagtctcgtgaaattgtggatcttaaccagtataacaagtggggaatgggatctctgtgtagctttattgtgatgcactgatgcatctcttcacatgtttgaaccacctgtcttttctgtgagctcgctgctcagatcccttgttcattcttctatcgggagatataagtccttaaacatgggagagtgatttgtcttttgtgatataagttgcaactagcatttgtttgtctcttggtgaccctggggactgagcctccccaggtgtgagagaacatcagcccttgccaggtgattgctttgttttctggccccttctgtgttgcagaatgggacctttgtggtcatgtagtctgaccctgtctttgattcattgttatcacactaatgttttctctgtgttgagagaattactaccctctggctttgaattgcctggtatccagtctcttccttggacattgttcccttattctgagtgtatgcctcaactcggattagattacaaacaaaaatcaggctaacttggaattaaaataaaaaccaagctggtgcggtggtgtgctcctgtagtcccatctcacaggcgaggccaaggttgggggatcacttgagcccaggagttcgagcttgtagtgctctatgctggtgtctgagtagccactgtactccagccccagcaacatggtgagaccctgtctcttaaaaatttgtttaaataaaaaccaaaccattgactttatatttctttttcttcttctttttttttttttttttgagatggaatatccttctgttgcccaggctggagtgcattcttctgcctcagcctcccgagtagctgggactacaggtgcacatcaccatgcctggctaatttttgtatttttagtagagatggggtttccccatattggccaggctggtctcgaactcctgaccttgtagatccgcccggctcggcctcccaaaatgctgggatgacaggcgtgagccaccgtgcccggctcgttgactttatatttctaaaggaagaatggactatgatttcttaggtttgaatcgtgctggaaagttgaaaggagacaaaaccttggactgcctgttgtgtgatctgcaggctgcggaggagctcagaacttgaggcaacccagcgccacctagtggatattaaaggaggacaggaatctgagttttgctgaaaaaggctcctaagctgttgttcagcacgtagcattctttcctgacctacgcattctgtttgttagtgcccaggatcacatttcctccatccaaactcccaccctaacagtcttgggtcctggagcttgccccagggatgctggcagctatgtttctctggcaggagtccaggcagtagtaccctccctgtacccatccttgtctggcactggcatggctctgcagccacccaggagcccctctgggctgtggcctctcgtctgtcctcatcccatcaggtccatggttggcctcaagggtctggtctgctgctgctcactcttctgcactgagaggaggagactgagtttccattactgatcaggtgacctaggacagagcgcctttctcctgatggtgactgactgccagatctgggggaatctcagaacagaactgaaagaccagaagctgtgagattaatgaggttggagattggggtgggatttttcaaaggaattgttcctggttcctttttttttttttttttttttttttttttaatttaaggcagggtctcactctattgccaggctggagcgcaatcttggctcactgcaacatctgtctcccaggctcaggtgatccttccatctcggcctcccgagtagctgggactataggcacccgcccccatgcctgaatagtttttgtatttttttgtggaaatgggattttgccatgttaccctggctgatcttgaattcctggactcaagcaatctacccaccttagcctcccaaagtgctgggattataggcgtgagccaccatgccctgcccccagttgctattttatttatttatttatttatttgtttgtttgagacggagtcttgcttcgtcacccaggctggagtgcaatggcacaatctcagttcactgcaacctccgtctcccgggcttaagtgattctcctgcctcagcctcctgagcagctgggattacggcgcctgccaccaggcctggctaatttttgtatttttagtagagatggagtttcaccatgttggccagcctggtcttgaactcctgacctcgtgatctgccaacctcgacctcccaaagtgctaggactacaggcgtgagccaccacgtccggtccccagttgctattttaattaaagctagggttatggtgtggctgaatagcctggtggccctgtcctgcaggacctaacatctgtgaatataggctgggaatgtgaatcgctcaggaggccaccccaacacttgtgccagacctagcacttgtgtctccctgtggatcccagtggccctcagtgacagcatgtcactcattcatatgaccattgaattgtgtctcccaggagggcagggatgtctcttcactttctgcaacacagcccctacactcagcctgtggaggagcacagctcatccgctaggggtcgacggaatgtgtgggtgggaataacagcagtgtagattccatggagtgtgaagaagtgatttgctgaatggttctccgagttaacaggacctgtggtggggagtgatgtccagggtctggctgggtaggtggtacttggtgcggagccttgcactgcaaactgtcgagagcagggttggtcccatggaccctctgtgaatatcctgagagttgtagtacccatttccataaaaatgcacctatatataaactttcgtttgaaatttcaaggtaggctgtttggaacccacatagatcttttgggttatgcagcatcccactacttatggtaggaagccaggcccatccgtgggaccagaggatgcagaggtttgcaggatagcttcacaggtcctgtccagttctaaggttaggaatggatgctttctcagatgctaaaagctgaggggactagactaagcttgtgcacatttctgtcttggagatgaacggcgagagtgtgtttgaagccagccattcccttttgcatagtcattgtcaggatgcagggctttggctggggcacctatctcctgtcacagactgggctgggccctcttggctggcccagagctgtgtgaggggctggataagtcttgaggaggacagtgttttcctccagagtgttttcagaccaaaccattaaacaccttgcaaatagaagtgcaagctcggcaggaaacctttcagggcccaaaccctgcttgtgctaagggctcttgtcttaaagctgcagacttaaaaacagtgacaaacctttctctttccccttgttaacagacctcagtgcagctcctggcttaccctcttactgtgggggatttacaggctggaggttgggccggcacctttccagagcagtcatccctctgacatgttcagggaatttgcccaggtctgccatggcctttggggcactcctggtggcagcacttgtcaccgctctagggagctgggttagttcataaagaagcaccagcctcagtgcagagtgctctgagggagaaagcagcaggtgggtgagctgatgcttgggaaaatggagtaaagtccacgtggaagttagaggaaccaacatggcgtgtctctgccagaggagagggccccatgccagtgtacaaaccagaccacatgactgcggctccaaggacagctgacacggtgagggcagcagagatgaccaagctgggaagtcactagaagaaccttcatgtgaccctcctgccctcatttctccatacccatagctggaacttgttcctggctttccatgaggtgtgttccaagcccctgttcctttccctataactctctccagtttctaatgctccatacaatttgattacaattaggtgtctttttttttaaacgttaatttcaattttttttgagacagggtcttgctctgtcacccaggctggagtgcaatggcgcgatctcggctcactgcaacctccgcctcctgggttcaagtgattctcctgcctcagcctaccaagtagctgggattacaggcacctgccaccacacctggctaatttttttttttttttttgagatggagtttcacttttgttgcccaggctggagtgcaatggcacgatctcagctcagtgcaacctccgcctccgcctctacctcccaggttcaagtgattttcctgcctcagccttccaagtagctgggattacaggcatgcaccaccacgcccagctaattttgtacttttaatagagacggggtttctccctgttggtcagtctggtctcaaacttctgacctcaggtgatctgcccatctcagcctcccaaagtgctgggattacaggtgtgagccacggcacccggcctaatatttgtatttttagtagagacagggtttcaccatgttggccaggctggtctcgaactcctgacctcaagtgatcggcctgcctcggcctcccaggttttgggattacaggcgtgagccgccacgcccggccaattatgtgtctgtctagatgccgctgagtgaagcccccagcgtgcagagcagccaagttattttcttccctgctgcactccaagtacctaaactggtgctgggagccacagcacatgtcataaggcctcactgtgctcctagatggagcaaagacagctacatttgaaacaataggagcctccgtattctgattctgtggtgtcccaacagccactttgagctgcatcctaaataggacagaaacagaaaggccttgggtggggtgcggtggctcacgcctgtaatcctagcactttgaaaagccaaggtgggaggatcgcttgagcccaggagtttgagaccagcctaggcaacatagaccctgtctctacaaaaaaaaaaaaaaaaaaaaatcacccaggcgtgatgttgcacgtctgtagtcccagttacttgggaggttgtcttgagcccgggagatcaaggctgcagtgagcggagatggcgccactgcactccagcctgagcaacagtgagaccttgtctcagaaaaaagaaaaaaaaaatagaccttttatttccagtggccctcctttctgacccagatggtgacagcacagtgcatggggccacctctcgcttgccctttcttccctgtcgcatacggatgccaagatcctaactattgcttactcaagttgagtaacctggatcccctggacaaatctctcctggtgtgatctttaattccttagcggctgggacatttctcagggtttgatacgagtttttcaccctgcaaagaccctgaccaaagagaggtaaggttctgggagcctctgtctgccccgacatacttggttagcatgcagttctggaagaagctgagactgctgccctcctctgggaccttggggccatggtgttctctgagcaccccgtattgacgtgtcctaagagacgtccgaggggccgtttgtaccttctggcctggggcagccagaagtctggccaagtctcccggacttagccggatgtgggtgtgttggcctgtcccgccaactgggagctgagaatagcagaatagggtcagggggtgatgggaaaagcactagttggctgctctcctgggcagtggggcagtgaacagaggaaacatgatgcggggaggtgctgtagaaatgggcagtttggagaagaacttgtgtgtgttttgctcctattttagaactggtgtcattgtgaggcttcacaggctgcgttccctgtgcaggacacaaggaaggtgccggccactttgagtagccaggccttgacaagagtaggtggagatcccccctgttgcctggagcctccggggatgcggtgaaggccagctgcagacagctttgcttgagcagttgcatctcctctgtgtcatagaacaagtgctgttggctcttacttaaggcaagggcgctttgtggtgagcggtggagttgggtggcgccctggcttctccatcagggagttttagaagctcctggtgaaaacaactccttccttgttttgtgtggttccccgaggggatgacgtgggctgcatccccactgtggagcctgttcttggggcagggcttcctaggaaagacagtgcatgcagggagggcggtgtgttccttggcttcattcaggaaatgcagctccgtgcctatgtgcctgacacgttttacaatgtgtagagagcagagaatgaaacccacaagcccccctcctcaggagtgagttctggttggggagacagcattaggcagcgggtcaggggttggagtgtcaatggggctggggtcaggggtgcttcactgagaatgtgacacttgagtggagaccgatggagtaaaggagccttggggcgtctgcagagagtttgtgggcaagggcaaatgccagggccctgagcacagcgggacctgagtgactgggcacagggagtgaggccacaggaacgtgggtgttgcaggcccatggctgggactgcccaggtgggagtgtggggagcggtagtcagaggggccagtgctctgggtggcttgggcctggtgatgctgaaaaggcctggattttggacatccctgcaggtggagcagatgggatttgctgatggtttaaagtggactgtgaaagaaataaggaaactgggatggtgttgctatgtttggcctgagcaagctttgggacccgaaagaaccaagttacccttactgatagaatgtggagtgaaaggttttccgtcgtagtgaagtgttggggctggctagcacggctggcttgtggtgaccacttggtatccacatgcactgcaactgaggtgctgtgggcatctgcagactgcagggaggtgggcactgtgtgcttctcaccactggaacactctgggggacttggcattccttccctgccctcctcgccctctgagacagccactgttctgcctggacgtgcacctgtgacgggtcttcatgaggtgtgcagggcaggcccattcacagggaggatgtactctgggtgttgggtgtctgccaggggtctggacgggcaggggcctgagttagagtgcctctagtgcactgagtccccaggacagggtacggcttctctcaagccctggcagtctggttggactacagattccagggctagccagaaatatgtttctctttttctttcttcttcttcttcctttttttttttttttttttttttttttttgagacagagtcttgccttgttgcccaggctggagtgcagtggcgtgatgttagctcactgcaacctccacctcctgggttcaagtgattctcctgcctcagcctcccgagtagctgggactacaggcgcacgccaccacacctggctaatttttgtatttttagtagagacggggtttcaccatgttggccaggctggtcttgaactgctgacctcgtgatccacccaccttggcctcccaaagtgctgggattacaggcatgagccaccatgcccggcccccatattttcttttcttaaacataatgtgatcttaagagatgctctcctgcccgggtctccacctgcagtttcccctaagcagcaggggaatcagcaccattgagcagggtgttttctgatctgtgtgcatggttagaaagtttatgtgaacgggtaacagcgcccactctctgcagcctgtgcacgtcgggcgtagttcggcttcacatcaacagctggctggaggtgagcttctgcctgccccacaagatccactatgcggcctccagtctgatccccccagaggccatcgaacggagcctgaaagccatccggtaagtgcccagccccacgtgctcactccctgccagggcccttccctttagcttctgcctgagattttaccacttactttgttccaaaatttctctttttcttcttcccactgcggaagcttgcaggtggggctctgccgtttatagaagttaaaacacataattttgtatccagttgtgtccagaaatgaccaatcccaggtttctcctgggcccttctggcaccaccttaggcttgggcagggcagcctggatgtggggctgagtgtccttggggaggccggagggctggagggacttcatcttaatggtgttgccctaccccagtcttttgcatttcagtcagcactcatgggatctcagttattttctttttcttttttttttctttttcttttttttttttttttttgcgggggtgtgtgtgtgtgtgagagagagacagagttttgatcttatcgcccaggctggatttcagtagtgcgatcccggctcaccactacgtccacctcccaagttcaagtgattctcctgcctcaggctcccgagtagttgggattacaggcgcccactgccatgcctggctaatttttttggtacttttagtagagacagggtttcaccatgttggccagactggtctcgaactcctgacctcaggtgatccactcatcgctcatctcagcctcccaaaatatactttcttaatttaattgacttttttttttttttttgagatgtagtcttgctcggggctcaagtgcagtggcacagtctccactcagtgaagcctctgtctcccgggttcaagcgattctcctgcctcagccccctgagtagctgggattatgggtgcacaccactacacctggctaatttttgtatttttagtagagatggggtttcaccatgttggccaggctcgtcttgaactcctgacctcgtgatccacccgcctcggcctgccaaagtgctgggttacaggtgttagccaccatgccctggcaatttaattgattttctgcaaggaaagaactgagcccagtcttctggcaccacctgttcccaagtcccccaataccttgaacattttttaattataaaaatatatctgggcacattgctgaaaatttggaaatgacagaaagcaaagcgctgcctagttccaccctccccagtccgtgctctttgctttcaatcctagctaagcatattttaatgtactttggtccctagtctgtgaggaggattttgcttttcccatatttgggacaatttccttaggaaagattcattcatgtcttcaatcaacagatgtttgctgggcgtctctgaggtgggatacagagtccagtcttcgagccttccccacttttgtcgtgtttttttccgagggtgacataatccttgcaggttttgtttttgttgtttttgagacagagtctcactctgtcgccaggctggagtgcaatggcgcaatctcggctcactgcaagctccgcctcccaggctcaagtgattctcctgcctcagcctgccgagtagctgggaccccaggtgggtgcaaccacacccggataatttttttatttttagtagagatggggtttcaccatgttggccaggctggcctcgaactcctgacctcacgtgacctgcctgccttggcctcccagagtgccgggattataggcatgagccagtccttggcagattttgtgaaggcctccaaacagaccactgcccttttctcaaatcccgctcttggcccttctctccgcagttaagggccaggaggctccagctgcctgtttgtgtcccaggtgcatacctgatgcacacccggtgcaggacctcgtgcaggacctggtgcatacctggtgcagggttccctgcacttcgtatgttccgtgtgtttgagtcccaggtgcatacctggtgcatacccggtgcatacctggtgcaggacctggtgcatacccggtgcatacctggtgcaggacctggtgcatacctggtgcagggttcctgcacttcgtgtgttccgtgacaggtgattgttttgcagcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggtatagctctggaggcccagatgggtggcatgtggcggtgctggggcatcaggaaaggcaggccgcctgccacagtacatccacaggggctgtgtccagctgagagccgcggcacagcccaccatggggtggggccagtccctgggatggctggaggttttggcatctgagtcagacctgggttcagggctggctttgtgagtgagccacgggactgacttgttcttctgtctcagagaggtaaggcgagtctgtgagagaaaggactggggtgcttgcagtcctggaggttgaggcaccagagctagggggtgggcagggcagcagcgggcagggccatgggggtctcacagtggtgcatgaacaacatacgggaactaagggcaggaagcttggatgcggggccctcccatgtgcagaacagagacctaacctggtggccttacgcccctgtgtgtgcacatgtgttggcctgtgcactctgtacaagatgccacgtccttgctgagccacatgcttatgggcctgtccatgcagagggctgccctttctgattagatggagggcccctcagcctcgtctgcggatctggttggagtgtgggaggaaaagcgcaggcaaggctgggcacggtggctcatgcctgtcatcctagcccaggactttgagaccagcctgagcaacatggcaaaaccccgtctctacaaaaaatacaaaaaaaaaaaaaaaaaaaaatagctgggtgtggtggcgtgcacctgtagtcccagctacttgggggtatgaggtgtgaggatcaattgagcctgggaggcagaggttgcagttagctgagattgtgccactgtactccagcctgggcgactctgtttccaaaaaaaaaaaaagcacggggagaaatcagaagcaggggctgctgatggggtggccaacaggccatgggatcagctgtggctgctagtcatgtgggcgtggcccagagccacgggaccattgaaatactgcctgagggtgggagcaggtggtgcctgtgggtggcgccctcgtctggtggcggtgtgcacagcatggccaccagggggcagcagaggctgccgaggaacacaggcgtgaggtgggcccgcctgggtccctctggctgagcttccatgctcttttggcctgtgaaacaggtctctgcttcttagcacgttaggggaacttgtccaacaaggcctgactctcaggccacttttccccgaaagcagcctttttggattctgtctttgagagtaagtctcccgcctctgtatctcaggaccctttatctatcctctgtgagagcacttaccaaattgtgcccttgtatttcttttttcttttctgagacaggttcttgctctgtctcccaggctggcatgtggtggtgccatcatgatccacccaggctcaagcatcctcccaagtagctgggactacaggtgtgcgcctggctaatatttttttttttttttttttttttggtagagacggggtttccctatgttgccctggctggcctcatactcctgggctcaagtgatcatcgcaccttggcctcctaaagggctggtattacaggcatgagccaccatgcccagctgtgcctttggacttcatgggctggacaggactcagtaaagaccatgtcctgcccaccttcatagcattcaggagacagagaattttaaaagaactcaccactccatacaaccctgcagagtgagggaggcagtgaccctccgtgtcctgatgagcaccgaccacatggtaaatgcctgtggctgttcactggtcctgtgttgagcttttgaaaggagctgggcctggctttcctgaggctgtctggcaggagtttgtgctggacactgtgcctctcatccttgctgtcagagtctccttggacaaagctttgatgccctcttctgaggttgtctggcaggagtttgtgtggacagtgtgcctctcacccttgctctcagagtctccttggacaaagctttggtctccttttgatgtccccttcacttccctgccgtggccttgactggggagagggaaggctgtttgtcattgttttcttctgtctgtaccccttccctgctgtccctgctgcaggtcagcagggcgttgctgctggtgtggcggtgcggaagcccctggggcccagccctggtgggtcactctgtttccggagatagccccctggggagcacctgcctcaggtgtgaatgtcaccagatagtttaaagtccctcatgtggctgggtgcagtggctcatgcctgtaatcccagcactttgggaggatgaggcaggaggattgcctaagcccaggaggtcacgaccagcctaggcaacataggaagaccctgtctttacagaaaattaaataattagctgggcatggtggtgtgtgcccatggtcccagctactcaggaggctgaggtgggaggatcacttgagccctggtgttcgaggctgcagtgaattgtgattttacacactgcagtctgggcaacagagcaagacccagtctcaaaaaataaaataaaataaaattcttcatgtttatatcaatccagagagaatctacaagtaaattttgggtgtgtcatgataaaattagtatgttacaagacttcaaacactacacaaattatagacacagaaagttcccacagtcccatatcccacaggtaacctagatccctccaggttttttatctgtatatatacattttattgtgtgtgtgtgtgtgtgtgtgtgtatatatatatatatatatatatatacacacacacaaacattttattttgtattatgaaaattaggatcgtgctgtatattcgttgtgattggctgaataatggcccccacagatatacacatcctaatccccaaaatctatgaatgtgaactcatgtgggactttggagatgttactaagtagaagatcttgagatgggaagatcatcctgttgagctctaaatgtaatctctaaggcccttatcagagggaggcagaggaagatctgataaaaagaggcagcgatgtggccacagagacagagtggagtgacgtgaccgcaagccaagagacactggccgttgaagaggcaggacgaattctcttctggagcttccagagggagcctggtcctgctggcaccttatgcttgcccttaagtactgattttggattttcaatttccagaatggacagcatcttggagaggctgctgcagggagaggcaggaggtggagaccactatgctgagcagagctgggggaaagtgggggtgtctttttgagagagacatgcgagtggcacgtggggtgagggaacagggcggtgatggagctgaaacctgccatgtcggggttggcggagccattgggggcactactcgcacaatcttggctcactgcaacccccacctcccaggtgcaagcaatcctcctgtctcagcctccaagtagctgggactacaggcatgtgccgcagtgcctggctaattaaataaaaatttttggcagagatgagggtctcactatattgcccaggttggtctcgaactccgaggttcaggcgatcctcctgccttgccctcccaaaatgctgggactacaggcatgagccactcactcagtctggaggccctgttttctgagctgaggtataagtgtcctcagcagcagggcagcacggtgtccaggcaggggtgactcacctccacagaggcctacccgccaagagggtggagtggtgtcctgggctgatgcagaggcagaagtgcgagagcttaggatttcacacaccttttcgtgaagtgctggggtgctgtgctctcagacctcaggcctgagctttcctctggaaggggtttgggttgtgtttgtgtttcctgatgttcaagggtccacaagagcaaagctgggaggggggtctctgtgggagtcggggcacatggggcagacctggggcctttgggtatgtaggggtggcatgctgagtgactccacacccatcatcggggcaaggccatgctggagttttagggggtataagagggctgtgcccctgccaggacatccagctaagccccctgcccagctgggccagcactgtgttcccagcaccccagacattcccatgcttgtggcctgagaccaccattcttcagtgggagtcaagacagcataggatgggaaaacagtgccaccaaacagcacagggagcagtgacaaaaaggccattgtggccgggtgcggtggctcatgcctgtaatcccagcactttggaaggccaaggtgggtggatcacgaggtcagatcgagaccatcctggccaacatggtgaaaccctgtctctactaaaaatacaaaaattagctgggcgtggtggcatgtgcctgtaatcccagctactcaggaggctgaggcaggagaatcgcttgaacctgggaggcaagaggttgcagtgagctgagattgtgccactgcactccagcctgggcgacagagcaagactgtctccaaaaaaaaaaaaaaaaaaaccattgctcacagaaagtgctgtgtgctggctgtgccccacatcctagtgagaggttgcgaaggtgctattccacgttagggaggaagtctcgggccatagccaccaggtgtgttctgcatgaggctggggccagcttctccaggctggtaggccatggccacccaggctgagagctgctgacagctcccggtgggccagcctcaggcatggtccttgcagcttcccttttgcctgcaggttttccagcttgcagctcatctggtgtactggggcaaggccatcatcatctacccgctgtgtgagaacaacgtctacatgctgtctcccaatgccagcgtatgtctgtgagtgctgctggctgccagagcctggagccccgagtgggaaggggtgaggctggcagggccctccagatgctgttctctgtgttggccaggcaccaaaggctgtggaagccccaaggccaggctctcacttcagcctaactcctggccactagcatacccaggtcccaattctggtctggctctgtgctctgtggctctcctgtgtcccccatatgcctggccccctcctccaggctggctcttctaatccaccttgagggatcagaggtgagatgcaggatgaactgtgcccatggctcctgctgctgctcaaggggaagtgcccaggctctgtccacctggaggcctgcctggcctcataccgttctgccctcatcgcactgtcctggcccacctgccacactttgcttctctgctgcccactgaggccagtgttgagaacacggtgggggggtctgctgcactcactggcatgctcacctgcctgcaggtactccccgctggccgagcagttctcccaccagttcccatctcatgacctgccgtccgttcttgccaagttctccttgccggtctccttgtcagaatttaggaatcccctggcccccgctgtgcaggaggtgagtcacagaagctcaaggagcccagagtggcaggtgtgtagtggataggcactacctgcctggctgttggttctgatctgagagccctcagcactgccacctgcttctccttggttttgggggcttgccgtgcaagtgctacgtgcccagcaggacccaaaagtcagctgccgggccacctgcagatgcttggccagtgacccaacacttgagcagttgttccctccccatagagcccaccctggctgtggcaggcagtttttagtgttagaaccgagttaagcaggagagtgcttaccttttctgggcctacagacctgccttgtacccctttgggactggggactgcctacagatgagggtgcaaaggcagttttgttctcactgggccaggcctgaccctctgagagttctgcttctgtcttcactccctgccatggttcaggtggccacagggtctgtgggtatgagttctggggtcactggtccccagaatctcctcattcaagagagcctagagaggaccctagtgggcctggatcagggcaacgggcaggcaggttgggagctaggagtggctgggggataggaggcctcctgcaggtctgtgggatgaactggtgcacctgcatctgtggcagggccagtggcttcccctgtgggctgcaggtgtcatagccttgtgctgaggtggctttgccatcctcccctccactgagttctgggcagagactcagagcagggccagataggatacggtgttggagacagacgagctgggtgttctcaagtctttgtctccagaagtatctgagtaagtgccagatctattaggcaaaaccagtccttaaagttaaaccctttccgttctcaaattacgaatgagaacgattctggcttttcagctccgttagacgctaaacctgacagagctctcagtgcggtctttcacagagcccttggtttctgggagctgagccaggttgtaccagctgaataaaaggcactctctgcacccctgctcttggggcagtgcttagggaggagctgctggtgctcccttctcagaggcctcctgtggtctagataacggagtggcttttccaggccatgactgagtggttgctccaggccttgtcaaggggcctaggtcagccaggttctgcctgggctccagtgctgggaagcccctctgttttatttttggtttattgattttatttaattttgattgcacgtcaggctggagtgcaatggcatgatctcggctcactgcaacctttgcctcccgggttcaagcaatctcctgcctcaccctcccgagtagctgggtttacaggtgcccgccaccacgcctggctaattttttgtatttttagtagagacggggtttcaccgtgttgaccagggtggtctctaactcctgacctcaggtgatccacccacctcatcctctcaaagtgctgggattacaggcatgagccactacgcccagctttttttttattgttttgatatagaaacttgctttgttgtccaggctgaagtacagtggcgtgatcttggctcactgcaacctccgcctcccaggttcaagtgattctcctgcctcagcctcccaagtagctgggattacaggtgtgtgccaccacaccaggctaatttttgtatctttagtagagatgaggtttcactgtgttggcaaggctggtctcgaactcctgagctcaagtgatccacccgcgtctgttttatttcttaaattcatgtgaagtctggatatcttgcagtccttttgaccaagtcttcttacttgcctgggatatatcccccattcccatccccagttccccagccccctcccaggaggtgaccctggccagcagctccttgttgaccctcccagagatgagtagacagatgtgtatctgaggacactgatgtgtctcacactccttactgttcaacgcctgagtctgggcagtactttctcatggggactggactctacctggcacaaggctcctcactgctcctcactgccagccccacctgctaacccagagacattggagggcctggccaggacgtgccttctcacggtgggggtgggggtggggtgctccacccccaagcccagggtcactggcctcagctttcttgtggatccactcttgtgctcagggtggactttcaggtagatccaaggagaggactttctgctctcagggtacctgcccacagcctctttttaaacagtgtctgggcttgtgtggaggtggacttgctggctgggtccaactccagggccagtgggccaaagaagagaggaggcagaggggcagctgcagcagcacagggtggggggtttgctcagcgaagcagtcacaggggcctccacgtctcaggtcctgctcctcagccagatgctgggtggccccggtgtgtggtgggagcctgtgcaggtgtgatccagatgttcccctggcccctctcccttcccaggagggtgagcgggccttgcagagctggctggcagctgggggctccctttctgagaagagggcctttctgcctgtgcgtcagcacagggagcgtgctgtggccatgtctagggccatggctccctgatcacccaggaggaagttggagtggggagggggaccagcctcacctgctgccacccgcagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaagtaggacccccagggcaccgctgtggtagtcaggggagacgcttgggggtggcatccaggaggctcaacgtgggcggtgctgtgagtgatgaggggcctccacacagctgcacacgcacatgcacgtgcctcgtgtcccccgtggagacacctctcctgtctcctagcaccaccgtgactctgaggtggcagctctgtctccgggctcttcagcaggcttgctagaattaggggcagctcccagcccagcaaatcagtgctggaatctctgccccagcctgggagcagagcaggatctcataccactaccaggacagctgacacctctgcgccccagaagagctgtcatggccagtgtggcttgagggcagcagcctgttgccaggtcccaggtccccggtccccaggcttggggaaggaagggggtggaagactttgaaagtccccccttggctgaggtctggctgtaggcttcatgcttcatgtgaggaccccacctgcccagggtgctttgtcctccatcctgggtgagggacaggatgcccaggcccaccttggggtgtttgtggggcacacatcgcacctctgttcaggtcccttgaggttgcccccagaggggaggctacccgtttcccaagtcagccgtatgaggggcgtgtcacacccaggaggtggggcagcagcgaatgcttgcaggcagatgtaccctaacccttgtaggagttaggggtgtcattggaggctggctgctggctctgccctcgctgttcccctgggtgtcctggaattccacttggtcaccctgacccatgtcccccacagccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggtgggtgtaggttgacccgttgggactggggccagttgcagggtcagggcagaaagtggatagggacgtacgcaacagaaccaccaaatccactgagaacagatggggccctgttcgagatggagtctctgcattcaggtgtgtaggggcaggtgccactgcccaggcctgagggttcggcttgtcaccaagacgccgggccatgggcctggcatgcctatttttcggactcttctctctccagtacttcttagatgttccttttcccttgagaggcagtgccaagttcttttttttttttttgagacggagtctcgctctgtcacccaggccggactgcggactgcagtggcgcaatctcggctcactgcaagctccgcttcccgggttcacgccattctcctgcctcagcctcctgagtagctgggactacaggcgcccgccaccacgcccggctaatttaagtgccaagttctcaccctcatgggacttggcaggggtttgcccaggactgtaagccctgcgggcatccagggtcccccatgttaaaggtgatgtggctcagtggtctctgtcagccccaccctgacttgggggacagtgcaggggcatagtttcccgggagtggtcgggttgtcagggactgagtttccggttaagaaccacactcagccctcgagagaaccacttgcaactcttctgagcagctggtccaggtctcacctgcatcctagcctcctctgtgccagcctgagttgcagaaagcaccctaaagcagtgaccttccaaatgatggtgacattaaaaaaaaaaaaaaaagtcaggcgcggtggctcatgcctgtaatcccagcactttgggaggctgaggtgggtggatcacgaggtcaggagatcgagatcatcctggctaacatggtgaaaccccgtctctactaaaaaatacaaaaaattagctgggtgtggtggcgggcgcctgtaatcccagctactggggaggctgaggcaggagaatggcctgaaggcaggaggcggagcttggcgggaggaggagaatggcgggaaggcgggaggtgcagtgagcccagatcgcgccactgcacctccagcctgggcagcagagcgagactccgtctcaaaaaaaaaaaaaggaggctgggcacagtggctcacggttataatctcagcactttgggaggctgaggtgggtggatcacctgagttcaggagttcgagaccagcctggccaacatataatgaaaccctgtctctactaaaaaagagagaaattagccaggtgtggtagcgcactcctgtagtcccagcttacctgggaagctgacgcaggagaatcgcttgaatctgggaggcgggaggttgcagtgagctgagatcgagccactgcaatctagcctgggtgactgagtgagactccgtctctcaaaaaaaggaaaaaaaaaagcagtgaccatttggctccagagctacgtgggactcactgtagcacgaaaaagaagccaccagcagaaccctggtcccaacatcaggacgcaggcttgggcacctctgggtttgaacagccgtctgccgtcctgaacccactccgcccacctggtggtcagcgggaccgtggtgggcatggggtccaggaggcctgcccacccttgttggggggctgtggtggctgcctccctggccttcaccaccagctctgttcaggcctgtgggcagctcagagctgattcccagcagtggctcttcagcagaggcctctgggggctggtgtcaggttgggctcacgcccacccatcccttccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtcccctgtgggacggacagtttggaagtggagcctccctaggctcctgtcctctctgccctagtacacatccagacatcctgtgctgcagggagggtgcagctgccttcctgcctgggccagggacctgctctgtgcacctgcaccatctcctgggtctgacctggtgggagggggctgcacctcactgtgtccagacccctctgcctaccttgccatcctccaagcctgcaccatgaggtgtgcctcctgtgggcacctctggcttccaccaccaggcagggcctcccccactgtggccgcccccacaaagccagactgttaaaaacacatgacaaatgctgggtatcagttcctttccacctggcttcccctggtcttgtgactggcagcagctataaagccagcaaaggaagctccagagagccagtcctcgggtgcgatcattcagccaggaagcaggaagccttggcctagccaggccccagcgctccccttctgcctcacccactcagtgtttgtgttggtcaagtggtgggggctaggagttggcttagagcagctgccagtgtgcaccggatgttgggagagcccatgcaatgactcagtggaaggactgactgcaacaccctgcacaggcagggcaggaggaggctgacgaagccccctcacctcccttgggatccctcctccagcctagccccctccctcaccaggccaggccccttgagaaacagagacagcaagcgaaggctcctgggcccaggggctcactcaagcacagatacccgaattccctctgccctgcaggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagcaaagcctttaagttcccgtccattctgtgattcccacgctgcttccagctcaccaggtggggtgcctgctgcccaccctgacccacctcagtagggaggagcaggaccctctacatccctgtgggtgcagggcacacgcccctcgttgtctcactgagcccccacagagccgcctgcaaatgagtcaaagcctggccgccctcatcaccacagccccgtgccctggctccttcacacagaacacatccaagtcccacatcctgacaaaaacatgacccctttgatcacttcctgccaaacctccctttcctcaccgactcctccgctgaccctaagtccccctgctgtgcccactgctccatccttggcaacctgaccacgctgctcttagcactgcagtcatcctcttctccaatcagcttctcatcctcatgtgctgcctccgtcaagggcaggcgacactgtgtcctcggccttctttctgcctccactccaaccaaccctttcttttcctttcctttttttttttttttgagatggagtctcgctctgtcacccaggctggagtgcaatggcgcgatcttggctccctgcaacctccgcctcccgggttcaagcgattctcctgcctccgcctccctagtagctgggattacaggtgcccactaccacacccagctaatttttgtatttttggtagagacagagtttcaccgtgttggccaggctggtgtcgaactcctgacctcaggtgatccgcccgcctcggcctcccgaagtgctgggatgacaggcgtgagccaccgcgcccggccccacccggccctttctacccctttaacctaaccagccctgccccgtcagcgtagccagagctcccgaaaccctggcctggcctggaagtggcacctcctcgctcaaatgctggccccacctcagtcctcctagtggtcccctggctgctagcggacagggctctgccggccctccaaccccccgtgccccagcactgctcaccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggacctgtgggcagtcagtttctgctcagggcgggaagggatgggggtccactcaccctaacagtgcccagcctggacctcatctccccagctcagggtgtgtcagccgcccaggtctagccagggaccttgccccgtctccatcctgcctcttctcttgctcctgctgaggctgaatgtggctattgagggcaccagttgtctcctccagccctgctagacaaccagaccgcaggccgaagatacctcaggccacagccaggctgggctgggaaccggcagtcatggattcaccttgcaggtcaagtcctctcagcaggaccctccattccccagattcctcctttcccaagtgcccttgagaaaaccatcagcatttagcacgaggccaggcatcacggaaggcacaggaccccaaggatgtccccacaccagctacctgggcaatcccagagcccgtgaagtcccctaaacctgggctgctgaggtggccacaagggaccctcatactcagctcccaccctccggctttctgagcagtaggcccagctgccccacggtgccccagcctggaccatggtcctggtaacggccaacagttgtgtcactgctcggagccccagagttaacagcagagcactggggaccaaccacatcccctgcacctctcgtttttaggccagataggtcagctggacagccaggctaccttcacctcagcccacgaagccctgtggtgccaaaggccatggtcagtatcacgggctggggaggaggggcact

SEQ ID NO: 14470 - DNA, 6585 bp, Human
agctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttacattttttctgtgctccttcccgggtagggtaagtggggcccgggagaacaagccccgccccgcccgtgccgcccttcgcggaaacgccggggccgcacatagctaacggtgccttgagctgctgctgctgtatgtggggtgttttttacggtccctaaagacggaagcggggcgggacgagggggtagacggatggcttttacagccagtcagcggtgggaggagggccaggcgcggcagatcggcttccggttccggtgggctctgaaccctgaaaggtgggcgcgggcaggtggggtgtgggggggcgccggggcagaaggggaggggcaggtgggtgcgggacaggggccggagtgagaaccgggggccggggtagggggtagggagtgagagcccgggggccggggtagcgggtgagagccgggggccggggtagggggtgagagccgggggccggggtagcgggtgagagccgggggccggggtagcgggtgagagccgggggcaggggtagggggtgagagccggggccggggtaggaggtgagagccggggccgggttaggaggtgagagccgggggccggggtagcgggtgagagccggggccggggtaggaggtgagagccgggggccggggtagcgggtgagagccgggggccggggtagggggtgagagccgggggccggggtagcgggtgagagccgggggccggggtagcgggtgagagccgggggccggggtaggaggtgagagccgggggccggggtagcgggtgagagccgggggccggggtagggggtgagagccgggggccggggtagcgggtgagagccgggggccggggtagggggtgagagccgggggccggggtagcgggtgagagtcgggggccggggtagggggtgagtgccgggggcctggccaggctgcgactgactgcgagcccccacctcccgccaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaaggtgggtccgcaggcggccttcaggggctcctctcagggcttggctgtgccggctctgtgccggacgcccggggtacctggagagacctgggtgggccctggggattacagcctggaggcgacacatctccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgaggctgcttgtggtggacttcctggcgggactgctgaagcctgtggggagacttgtgtcacctccaggttggaatgtgacaacctgtaaactgtggggtcgcacatgtttctgaaacacatgcagcaaccatgtgaccagggcgggaacgcccagcttgttggggagcagctgacttctgggtacacagtcaggacccgggtcgggctggggcggcactgggctgggggccggcccagttagctctaggtccccagtctgacagcagtggttctgtgatggagcctccgggggggaggtgagggcagttgccctgggccccccttggtatgtaagagaaagcagcagtactcatggaggctctgttgcaccctcagctctccaagaggctgaagaaagtgtggaagccacagctgtttgagcgagagttctacagtgagatcctggacaagaagttcacagtgactgtgaccatgcggaccctggacctcatcgatgaggcttacgggctcgacttttacatcctcaaggcaagcggggtggggcgagtcagtgcacacagggtctgggatgggccagtcagactcacgggagccccaggtcagcatcacaccggggcacgctgacatctgcacaggagggtcactgggaaagcgtgagtggggccatgcccctttctggccagcaccagtggggtttcctgccttcaggagaggctgtcgctctgtgggtggctgacttgcccgtggggcctgagcgagcacagccgcccctttccctgcacttggacttgcttctgtgctgatcccaccccccaggctggggtgctgaggcggccccacccgggccttctctgtcctgtcctgggaccaccagcggctagagaggagccaggtgggttggctggaagggtaggtggggccctgccaccagcacctggccccatgtgagccttctgccagaccccgaaggaggacctgtgctccaagtttgggatggacctgaagcgagggatgctgctgcggcttgcccggcaggacccccagctgcaccccgaggaccccgagcggcgggcagccatctacgacaagtacaaggtgagggtttccgtcccgctccctacacctggggactcctggcccggccctgggcctcactgccctttccatctctgcctgcctaggaatttgccatcccagaggaggaggcagagtgggtgggcctcacgctggaggaggccattgagaagcagagacttttggaggagaaggtgagtgtgtgagcaccagccgatgctgcctgcccagagcctggtgttcagggtctgggagtgtgctgccttggagagagcctgcacaaggggctggtgcactgggtgggcttggggaagagctgctgctctgcattgcccacccagaggagcatggcccgctccctcccctccaagtccccaccctgttctgtcccaggaccctcagtaggaggagtgggttcctgcactgagggtttgctcggccaccagcatcccagggtctggagcctgaggtagctgtcaggacagggagcccctgatggcatggcagctggctgcccctattccctctgtttatccatgaccacagggatgggacaggggtatgtgtgtgcctccggcatccccaagggagggggttcctcatctcaccgacaggactctgccctccagggcctctcatgccccggttcctctgggcggcagctgctgatcccatccccgtcggaactccagctgccctgggcttccctggcctcaccatgagcccctctctccttcaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgtatctttgctttgaggactggtgttctctttggggatcctgatcctgtcacccctgcccttgctgcccctgagacctcggatgagccgtgggcattgactctggctgtgcccgtcccccggtgagctgcagagagcgaggttcaattctgtgttttgtgtttttttttcttttctttttttgagacggagtcttgctcagtcgcccaggctggagtgcagtggcacgatctggactcactacaacctccacctccagagttcaagtgattgtcctgtctcagcctcctgagtagctgggattacaggcaccccgctatcatgtatggctaattgtattttagtagagaaggggtttcaccatgttggccaggctgggcttgaactcctgacctcaggtgacccacctgcctcaacctgccaaagtgttgggattacaggcgtgagccacctcccctggccgtattctgtgtctttctttcctctggtagagggtctggtgtagctgggggcatccaggggtgcagccggatgatgcccattccctctccattgcacattcctgcccttctcgaacattcttcagagcagggcaagggaggctgtggtctggctctgcaggtactggaaggaaccaggaggggcaggccctcagagggccgtgctggtgcagctgcctgagtcaggagcctctccctggtcagcactgttgtggcgagtggtacaggaggtgggggcgacacgaacttggggacctgcgaccttggtgtcccctcctgctacctccacctgacctgcagggtggaggtttggccagcgggaagccgggctgtgcaccctaaggcatttcccgccctgaggtttgggggtacctgaccctctcccccaacccttacctggaaatcctgatcctccggacccattcggttttcccagggagcacagagggagggctcccccagctgcatgtgcagaatgacaagggggggtttatgtcccctgagcctaagccagccccagctggtggcaggatggggtgaactggaggcagctgcctgacgtgggcctgctggctgattgaggggcccctggctcccaagggggctgtggcagagtccagagggagtctgcagttggccctgctggactgcaggggagcacgtggctcccggggccgcaaggggtccctggggtcaggacctgcctggttcagagccctgggagggcccccgaggtctctttccacaccgggcacctctgccgacatgtcctgctgctccccacaccagtgccttcatgtgatgcccctgctctgtgaacgaccttgaaaaaaattttaggccaggcacggtggctcacacctgtaatccgagcactttgggaggccgaggcgggtggatcacgaggtcaggagatagagaccatcctggccaacacggtgaaaccccatctctactaaaaatacaaaaaattagctaggcatgttgacacatgcctgtgatctcagctacacgggaggctgagggaggagaatcgcttgaacctggaaggcagagcttgcagtgagctgagattgcaccactgtactccagcttgggtgacagagcgagactctgtctcaaaaagaaaaaaaaaaaggccgggcgcagtggctcacgcctgtaatcccagcattttgggaggccgaggcgggcggatcacgaggtcaggaaatcgagacctaacacggtgaaaccccatctctactaaaaatacaaaaaagttagctgggcatggtggcaggtgcctgtagtcccagctactcgggaggctgaggcaggagaatggcatgaacccgggaggtggaggttacagtgagtggagatcgcaccactgcactctagcctgggcgacagagcgagacaccgtctcaaaaaaataaataaataaaaatcataccgggcactgtggcttacacctataatcccagcactttgggaggctgaggcaggca

SEQ ID NO: 14471 - DNA, 10980 bp, Human
acagtttgtctttgctcctcccaccattattcctaccttcttgtactgtacagtggcagaaagctgtttgggcccagtactcaagtatcttgactaatgagaatcataacacctgacttagaaatggtatccaaaaacgtcaggtgtttgctgcatgtttttgtatttcaggggatttttattttgtgtgtgtgtatgtgttacctatatgcttgcatagcttgaaatgcccttttgcagtcttgaggcctttcttacatatctgtctgcacacttcatatgcctgcatagcttgaaatgtccttctgtagccttgaggtgttcttaacttttttctgcttgctgctttacttgtgggatggctttaatgattgagcaattaaggtttatcttttttaaatagtatttgggttttttgtttttgtgtttttttgagacagagtttttctcttgttgtccaggctagagtgcaatggcgtgatcttggctcaccgcaacttaagcctcctgggttcaagcagttctcctgcctcagcctcccaagtagctgggattacaggcatgcaccactatgcctggctaattttgtatttttagtagaaacggggtttctccatgttggtcaggctggtctcaaactcctgacctcagatgatctgcccacctcggcctcccaaagtgctgggattacaggcatgagccactgcccccggcaatagcatttgctttaagatgaaatgttaagatggattccttctcagcccataggatcttctgattaaccatttcagggttttttttcccccatttttaatcctctcataaaaattttccccatttttagtcctctcataggaaatcttgagccattggaaagagctggttcacgttggtttcctgcttctcttaaatagtgtcataccaaagaaaatgcctgtttaaagtgaatttggttaccagtatagactttctcttgagaaaccaggaaggaaggatttttttcaccttagggaattaaaataaatttgtaatgttggtctcttgaagtgatagctttatagttttgttctaagtggtaggaaatattatctacagagattatggaaaaataatcttgtcctttaattgaacctcctagtggtctctatagttgaccctgcagttggtatcaggattttgaaccatgttttcattctgcatttatcttttctctgtatcattgatgcttttgacattaatatttgaattgagaagggggctggggcttttaccatctgggggtggatacaaggtctgtcataggttcacctaagacctgtcactactacttgcttctctgtatcaccctttaggtacttcctgcatagttgtttgttgcagtgttgttaaaatgagtgaaaattagtaaacttggtcttttaagactacagggccgggcgcagtggctcacgcctgtaatgccagcactttgggaggcccaggctggtgaatcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggtcgtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgtagtttactatgtaatatattttaatgtggttagatattacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatactttaacgcttggggtttgttgtgcttatctgctttgattcttcccccttacaccacaaagctccataggcagtgacaattaaaaatggataggtggagatcaatttcctgagcacgctggagatggagcatatgatagtcgaatgattgggcttcacctatctgttatctcctacttcccctgctcttcacatttaattcatagcagtttgggaattatgaattgaatgggagatttacgtttgcctgttttatccttcagtattcttagtttaaattaagtatgtgtcgtaagtcccttctttattaagcccatgaaacatgaaaaattatttttacccatcaaaacattaggaaatgaatgggctcctccctcttctcccaaaacttaaggccactagcatgattatagcgtacttcccatgtgcagtgtaacaggtaatgtaaaagacttttttttgttttgttttgagatggagtctcaccctgttgcccaggctggagtgcagtggcgtgatctcagctcactgcaacctctgccttccgagttgaggcgattttcctgcctcagcctcctgagtagctgggactacaggcgcctgccactatgcccggctaatttttgtattttagcagagaccgggtttcaccatgttggtcaggctgatcccaaactcctgacctcaagtgatccacctgccttggcctcccaaagtgctgggattacaggtgtgagccaccgtgccaggccaaagaagactttaatgaaaataatactacagagcagagacttttattgtcctctacccagtaatttgggtttactaatttggagtctcagggtagcaaattagaatatagggcctgggtgcagtggctcacacctgtaattccagcactttgggggtccaaggctggaggatcacttgacaccaggaattcaagaccagcctggccaacaaaatgagaccccttctctattaaaaaaaaaaaaaaagtgtgtgttttaagttagctgggcatggtggtgcatgcctgtagtcccagctacttgggctgaggtggaggatcgcttgagtcgggagttggaatcttcagtgagctatgattccactactgcactctcgtctgggcaacaaagcaagaccctgtctctggcggaggcaggctggggggtggggtaatgtagggaaggaggaaatgattagtatctgcagtacagaggactttttattcccccgggtgtctattaaaatagatctggataatggtgatgaatcatatttaattcaatcaccttttttttttttaataaactaaacacagtgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgtaagtataaaatattgcccaccagcttgtccttttgtaaaaggttgatggcttgatttcttttttgtttgtttgtttttttgagatggagtcttgctcttgtcgcccaggctggagtgcaatggcatgatcttggtcactgcaactgccgcctcctgggttcaagcgattctcctgcctgagcctcccaagtagctgggattataggtgcccaccaccacgcccagctaattttggtacttttagtagagatgggggttttgccatgttggccaggctggtcttgaactcctgacctcatgatcctcccgcctcggcctcccaaagtgttgggattgtaggcatgagccaccacgcctggccttttttttttttttttttttttttttttttttttcctgggagacagagtctccctctgtcacccaggctggagtgtagtggtgcagtttcggctcactgcaacctccgcctccagagtagctgggattacaagcgtgtaccaccacacccagctggtttttgtatatttagtagagacggggtttcaccatgttggccagactgatctcaaactcctgacatcaggtgatccacccgcctcggcctcccagagtgctgggattacaggcgtgaaccaccacaccaagcccacctttgacgacttgcttttttaaaattcagatacttttataaaaggcctcttaatcgtattttaaatattttaatacttaggacaataaggatgggcgtggtttagcctactttgtgtaaatgtgcagtaagtgctcatgccacttaggttgtgctagtgcaatttttcttagtttcatggatttgatccctgatcagaccaattacctgtgatccaaggctagcaatcttaaatacaaacaatactaagattggattatcgaaagcctttgcactacagtaagaacaacgcaaatagaactttctgattatagtccatcaatggcattgaccaccgaaaagtacttgcatgtcatctttgtattgccaaacaataccttgattttgaagtctgtaatctttgataatagttaaacacttttcttggcatgaattgagacattcagttcattcactatacatgtgttttggtccagtctttgctttacttatgtctctgtggcgtcaggcaaatcaggtaacttcttacttacacccttgattgtaaaacagattatacttgtcttgcctactgacctagtgtggcaatttggggaaacatcttggtgctgaattaggttctaggctcaggcactaaacatgatttaaaacttgatcatttgaactagaagccaagtacaaccttcaagacaactctgtataaggtcataggtataatcactattttacagatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaagtggggtaggtccatcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaaacaggctgacaaaccaagaggatttgccagaggtcttgatcctgaaagaataattggtgccacagacagcagtggagaattgatgtttctcatgaaatggtgagtatgcagagattgttacatttgaaagtaagagtagctttttttttttaatttgtgaaatggtttttcatcattaggtagggaaaaactatctgctgagaggatgattctggttacttttactagtagtgttttaaagcaagggtcagcaaactgtggcctgttttgaaaatgaagtttattagaacatagcaacaagtaacataactctcctggagcacttcaataccttttgtttggactattatttcttaaatgaatggctgtcggttgacatgaacaacttcgacttgtaactgaatttttctttttcttaaaacaggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctggtttgttgtaactgtcttctaaagaatgtaaagtattctgatagggctcagtgtgatgatagacacattttaattgatttccaaaatccatacagaaaaaggtaaataactgatgtttattaagtacctccttatatatatatatatatacccaccactgctctcagcggtgggttcacagatgatagagaaccttctattcatattagtagttggtggccctacattcaattttactaagggcatttctgaaaacaatatattgtcctttggccatgcatggtggcacacacctgtaatcccaaaatttggggaggccaacgcaggaagattacttgaatcccagaagtttgagatcagcccgggcaacagtgagacccccacctctacaagaaattttaaaattagctgggtgtggtggcttgcacctgtagtccttgctacttgggaaggtcccttaagcctaggagtttaaggttacagtgagctctatgtcaataccactgtgctccagcctggatgacagactgtttctcaaaaaatttgaaaaatattgtttttttatattctctagtgtttgtattagtttcttattggtgctttaacaaattaccacaaatttaacccatttatggctgaaaatagttctgtaggtcagaagtccaaaattaagcaagctgaagtcaggttatcaggggaattccttctggaggctttgatggcagaatctttccttctctcttccatttcaaaaggccacgtatattctttggttcctggccctttccatcttcagaatcagcaagcagtggagcatcttgcatcatctttctcgcccttcctctcttcctctttccatctctcctgtctaccacggtgtattatggaaggattgagccaaaccattcattcaaattcttgaattcctggagcttagatctttagctgaagagaaaaccctttttctatcatttctaccctctgatgtttatgtaataggcttcttgtaacaactcagatgctacagaagtaaggccacctcatcaatttccttgcttcaaacccgaagttcaattgatacccatatctctggatttcaagaccagcctggccaacataacaaaaccccctctctactaaaaatacaaaaattagccaggcatgggggtgtgttcctgtaatctcagctgctgtggaggctgaggcaggagaattgcttgaacccagggagcgggggttgcagtgagacaagattgcaccattgcactccatcctgggcgacgagtgaaactcaaaaaaaatagtttttaacaaaaaatatatttgcaatttatatttcacccagttgttatcttgggtcatcttacttaataaatacactaaaatatactctattctagcatagctgctagccactccagagaggttacctgggttggaatctgctatttgattctgaacaaattaatgtacttcacctctctgtgtctgagtttcctcatctgttattcatgggctcctataagggtgaaatgtatgcatgtgagacagaacagtgtcttgtgtttgtttagtaatcaagatattttatatctttttaaatagggacatagtagggtatcatatggcagctccccaacttaaccaattgctgggtatgagtactcaggtggttggtagtttcctactattagactaatgtagtgaggccgggcgaggtgtctcacgcctgtaatcccagctctttgg

SEQ ID NO: 14472 - DNA, 47476 bp, Human; identical to SEQ ID NO: 12179

SEQ ID NO: 14473 - DNA, 6350 bp, Human
attagtttactcgactacagagtaattacttcatattattgatatttacagcaggtattcaaatgcaatggtaggccattatttggagaaaatacataataagaatatttcttttccagtgcaatacacgattagatttgttattgagtcagttacagtcagctcagcaataaataaataaatcgatgttgacacttaaataccaaagatcttagagtttatactctaaatctccccaagatatgtaaataactttggctatttcctggagagggaaaaacaaaaggttatctttttacatatttttttattttccttcagcaacatcccagatccttccaagaagagagttgttgggaggcctcaggtctgggcccttctcagctcctggctctgcctggctgctctgtgctctgtgtcctctcctttctttcgcttcctccaaacattgctccttcaatcctgcaggatggggagcatattttgccttcttaatttattttttttcctcttctcaagaaagctagactcagagtattgctatggcctctctctatccttagcacaaacctagctttttaaagacatccctgtttccccaggtgcagggagttcgggaagcacctctcctttctctggtattgtattcctcctgtggaatgagcagtaggaaaggcacagagctctctgagtttttgccctgcacatcccttgctttcactctcacacattgcaaggaaggagagtaggagagtaggtgggttacccctttctcagccacctctccttggccctcagcccgtcctttccacctccattctccccacacccctggagctctgtaagcagcctgatgggccccccacgaagatgcagcatacccaggagaagtctcctcggatgtcagcgcctctaaagcagcccaaggcttgcctcaattgcatggtttcccgagtcctcagctccagaagaccaggcagatgggtggaccggtgagcagcagggcagcccctgtgcctctgtctctgccgagtcactccgaagcccggcaggcagcgaggaggagggagtttctccaaggacagaaggtgggatgaagaggtaggcagggaagatgaggggagaggtggatcccgggtaagacgaaggcccttccgggccctgcggatcagtgacaaaccgcggggagaagccgttctggctgttggcggtttagggacggaaggcactaaagcgcttcggaagtgaccatgaatgagagagtgtaatcaagtcaccgtgcaaatcggacaagccaccaggcaggcacatccacggcttcaaactctggccccgaaggggttccggctagggtcggaggcagaggcgcttcccagagcaagtctatgggagggggactgcgaagaagggggtgcaaatgcgagactccaggagaacagactccgagaccacaggccacacagcgacggactcccacctggctatccccagtccagggcatccctcacccacccggggagctgcgggtgggaggtggggacgagagttgagctctcaccgccctctgcacactcgagaacgaggaccctgcaattgagcacaagcatgctgcatgggggcgcaccccagcctctccgcgcgcgccgggaggccccccagccaacatgagttacaccggcgattacgtgctttcggtgagaacaccgagtgacgatctgttgcttcccctgaggtggctacaaagaaaggaagccgggagggaggggagaggaggaaaaaaaaaaaaggaaagggggggggaaaaggcccggactagctagcagcttgtcaatttcaacatcgggtcacatgaccagcacctccctgctaaggatggggatagatttccacgtcagcttacgtctccaaatttctacttcacggatccgcttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtacgtataaaggcagcgccctgcgctttatgaaaggggagttggaaatctagcgcagcaccgctgttaaatttttatatgctgttttataagcatataaggtttatgaagggcctttaggtttcccccaacaaaactttgttataaaaggcgggatcacgtggcgagtgctgaaattggccgtgaaatacccaccggccaaggcatgcctgcaaaaaaaaacaactccccttttcccttttttcccttctcagctcccaagcccagcagctcgaccccgctcggggccagctccaggctggggagccggaggtgggcgcctgtaaattccccctgcaagggcttcgggagcttttgatagcgaggtaatccggagatttttataaaagccatgtgttgcgccgggactccagtcccggccgggattcaaaggcgtcgctgtttaacgacggcgctaggagcgcgtttaacagataaagtagcccgcttagctctagcaatatattaaaagaacaaattaacccaaagttggcctttttgtccaaaggaagccattttcctctggcgtggtggcaattacgtgcctccttctgcccaactgcatgttattcacaattgttattcaatctgtcaaaagcgattttttttttgtcttgtgggtcttttttttttttttttttttttttttaaagggggagcaagtagagcctgcccgcagcttcgggaagccccctttcccttcaccctacctaagatagagccgctgctctgccgtgtgcaggatggccgtgtggccgtggtgctcagcgaaggcctagggtagggggcttccgccgccacctccccacctcggcggagccggaaggctggccggggaggcagaagctggtggccaggactcaggctgacaaagacccggcagccgccccagatgttaaggactgcccagtcttggccgcagccgggaaagactgggactggagccgcctttactgccttgggaaggggcagcccaggtgctggaaggtgaaatgtccgcaggcggctgtttgtttagtctggcctgcgagaggcagccggcaacccccacttggctgctttcaaagaggcttaggcagcgcaaactcgcctgttgctgtgcgaagctctcctttctgttctgggggcagcgggagcagcttccccgggggcctatttagggagctggcttttatctgtggctgagcctccaactgcggccgttccaagcatgcagtcggagcgttaaaggcaggggcctgggcagactttgacggggcttgggctggaccaccagtccccatggcagcccttctcctcagctatgggctctggggtggattgcagcccccacacctggctcaccccatgccttttctccctccacaggtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttgagtatcctggtgtgacattcctctccctgatcgccttttactaccaaatgtctgcccccctccccccacccccccaaaaaatgccttacctagttgaggagcaagttatcaggcccctgagggggtgagaaggtgactgagtcaggaattggctacaacagaagccaggcttaggaaaccaaggtggttggctacgtccttgtgggaagtggggacctgggtggtatctcagggcctggaatataggactttatcccctcagactgatctcagccctggagagggccttggggcctgaggtggccaacaggtcagaccccaggctgccctcgctcacctcaggacaggtaggcctgcagtggg

SEQ ID NO: 14474 - DNA, 38961 bp, Human; identical to SEQ ID NO: 12143

SEQ ID NO: 14475 - DNA, 10449 bp, Human
aagagaatttaattgagcaaaaaacaattcgtgaatctggcagcctccagtgccagagtaggctcagagagactccagtgcagccacatgggggaagatttatagacagaaaagggcaagtgaggcacagaaactgcaggattggatacagctccatgtttgccttatttgaacatggtttgaacaactgaacctctttgatttacagaaattcggggataggcacaagagcaggctacagtctgtttacacctccatttagattacaattcgctatgtacagagaaacctttaggccaaacttaaatcacatggggaggcagctttaggctaaacttgatttcacaaattttcaaattaacaagtaaaaactgtggatattattcaatttaatctttaagagtttattaatcaatatgcattataacttcatttttgtaaaaacaaaaaaagatatgcctagaaaagggttatggagagggcacaagggacgtttattttctaaaacatattttttataatggatttttttatataactttaaaaagaattagaaacgtttctgaattattaatgatttccttaaatctttagctacatatatttctccataaagagcagttcctcaaactgcatcacctcaaccctgatattatatatttttatttttatttttattttttgagacagagtttcgctctgtcaccagtctggagtgcagtggcacgatctcagctcactgcaacctccgcctctcgggttcaagcaattctcctgcctcagcctcctgagtagctgggactacaggcgcccgccaccacgcccagctaatttttgcatttttagtagagacagggtttcaccatgttggccaggatggtctcgatatcatgacctcgtgatccgcccgcctcggcctcccaaagtgctgggattacaggtgtaagccaccgcgcccggccggtattaaacatttttaaagtaaatttattaaatctcaaaagaagcacactttgaatactgaggaagagacgttgtaacccataagcagagagtaggtaagtaaaagcaatttccaccactctcagactgggcgtagtggctcacgcctgtaatcccaccacttttgggaggctgagaggggaggatcgcttgaggccaggaattcaagagcagcctaaggaaacttagccaaactccatttctacaaaagaaaaatttttaaagcaatttatttcaccattctcaacgcttttctcttttttattaaccaaatatttctgtaactcttttttttttttttttttttttttttggtattgaaagacatgggagaaggaagaattcctgaatgcaacagactgggaaggacgcaccacaaaacgctccgcggtctctggacaccctatcagctagtcccgtccctcctggtgtccggtctcgaccatccatcccgtgttttgggagtgcctttccttaccagattcttctaaagccctgatgcacccacccttaagtggaaggtaatgcttctgctgggggctgtgcgttcttccactccgtcccacctttgccgtggactaaacaggagccactgaacgagagtaccctggctcccggccctgcagattttcaccaaaaactctaggactaagttaaagtagggactgaaataccacacagagctcgctgtaaaccacccgctcagcgcagtaagtcgggatagtcagtagatctgagcccttgagggaggcgcctccccctcctccgcgcagcccccgggcgcccggcccagcttcccgcagccagggtgtattgaggtaggcgcgcccagacctgagacgggttgggactgggctgcgtcacgcgcgggctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggtgagcgcccccgaccagaccgagggacagggcgaagggggactggaggagggaacccccctttagggacactgagaggaggcgggcgcttctgggagtgagagcttctgcccggagctctgccagcctcgaggtggggaacgggggagggcggttggagaccccagggaggcgccggcaccactgggagggcccgggcggggcaggtcagtcatcctgtgggctgaagccggaccggaccgggcggcttcatgcccccagcctggccgcggagcccccgctccctgcaccgccgcaaacattctcggggcgcggcggcgcgtgcagagggcgagagcaggcggtgcggccccggtcctggcccgcccggagctccgggagctgcctgcctcggtccgggccctggccctggggcccctggcttccagcggcgcggccttgtgaccctgccccggtttaggggagcgagtagcacagacccaagtgtgggacggcgggaatagtgggtgctctccttcccagtgtctcctggaaagggattcccgaaaggttttattccaaaaggagaggttggaagacatagctcatctcctgctgtgtatcagccaagaaggtgtgaggtggtgttccttggggatccgcttgcatctacttgggatggtacgtcttcattagtgaggttttgcctggatgacctcagtacaattggtgcaaaacctggaccaactctttcctagttttctagttgttgccttaagcttctcacccgtcaggtatctttcacacccttctcataccctaaattatcgcatatgctgtttcaacgcctccaactctgcaggctgcttttaattttggtgggcccatcaaatacctccacttggcctgtttcagcctcttccacagtccttggggaaatgctagggagaataattgaaatatttctattccacgggggctgtaagatggctttttaggattggtctaatcagatactcatttcttttctctttctaggttttgaaacatgaatctttcgctcgtcctggctgccttttgcttgggaatagcctccgctgttccaaaatttgaccaaaatttggatacaaagtggtaccagtggaaggcaacacacagaagattatatggcgcggttggtaacatctgaaactgtccagagggactctggagagaatggtcctcgctgttgggagttgatagccagagagtagcttctagacaccagaccttaccaggcaataacctaacagcacccattataggtgcaatatgggcatatatctccattgtgtcttggcttggagaacagctcccagagaagtatcaacccatccctggccatggtttctcttccatttctgcccgcaaatcggcttggtgaacatgggttgggtaagtagacataaagtccaccagctatatgtttgcctctagaatgaagaaggatggaggagagcagtgtgggaaaagaatatgaaaatgattgaactgcacaatggggaatacagccaagggaaacatggcttcacaatggccatgaatgcttttggtgacatggtgagtgtggcaaggattgctgaactctgtgctgcttctcagttcttcaccaaaatagtcttgcttttaacattttatttacttctccttgaagaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcaggtgagacagcgtcagattcagaccctgtctccacaggaaagccaagaaggaattggtgtcattgctgtggtagatggtggcacaacatatggtgatgggttttttgtatttttggtttttggtgttttttttgtttgcttgtttgagacggagtttagctcttgttgcccaggctggattgcaatggcgtgatctcgtctcactgcaacctctgcctcctgggttcaagagattctcctgcctccacctcccgagtagctgggattgcaagtgctcaccaccatgcccagctaatttttgtgtatttttagtagcgacagggtttcaccatgttggccaggcggatttcaaactcctctcctcaagtgatctgcccgcctcggcctcccaaagtgtggcgatgggttttttttttttttaaagaatattaaggtaattcaattatggggtactgtatttgtattggtcttgtaaatttacagctttttttttctccctttttagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggtaaatggagctccttatcttgtcattcgtgctctgcttttggaaagtggaacactttcagagataacagatacttttttcagaattcacattttatatggtagaatctacatctgcaaaccgtgagtattgtcattataaattattagcctttggccaggcgtggtggatcacctgtaatcccagcagtttgggaggccgagacaggcggatcacgaggtcaggagatcaagacaatcctggctaacacagtgaaaccccgtctctactaaaaatacaaaaaaattagcccggcctggtggcgggtgcccgtagtcccagctactcaggagactgaggcaggagaatgacgtgaacccgggaggcggagcttgcagtgagccaagatcgcaccactacactccagcctgggccgcagagcgagactccatctcaaaaaaaaaaaaaaattattagcctttgcacagttctctggtgagatggtcaacagctaatggttaccatataagtaccattagatggttaacacacagctgttcttgcttttacataacatggagaataagcaaaccattctacatataatagaactttatccattgtgaaaaattttttatggacagattgacctaggggttctcattgaagaaatgtcaactaatttttcattttcaaatcaacaaatagcattttatttcatgggacgatttataagggtgttgatttggaaatcctaggttgcaaattgctgagtgtttcggttctagaactaatgttccccaggaggtagatggtagtgatcaagtctctccccctttaactttaaaaggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggtaagtgtcattttattatagaaatttaggcagaattgggaagcatcactgtgattgattcttggatatgacatcctgctttgcaggaatgtagtattttgagagtgagcatttaacatagtgatgtttgcatttgacatgagaaaatacttagttatgttaaacttctcataaatatttttaaatggctatgtaattgtatagagacaacctaattttccaaactattttccagttgttgggcctttttttctcaaagttttttactactgtaattaggactgtaaagaatccccttcaagtttttgtttgtttattttggtgctattttagactgacatcctaggaacagaaagggattatgcgagttggtatttgggctcagagatatctaaatcaccttagctgtaaacaataggttttatcttttggattttcattttttttggtagaaaatatcttgaacttagttgaagttagttgatttctagtgagttgaggttgacttttttcctttatcagccattactgttttccggccaatattgtttgggtccttatttggcatttgtttatgacattttactgaatttagagatgcctcccttatggagggtggtagggtgggttactgtcacatgtcgcttggagcttctcaccccagcattaattttactctcccaggcatttattttgaaccagactgcagcagcaaaaacctggatcatggtgttctggtggttggctacggctttgaaggagcaaattcgaataacagcaagtattggctcgtcaaaaacaggtataaaactcaaaattgaaaagggaatttttgttccaaatcagtatttggatacaagttcacaaaagctcaatttcaaaattccgaaagtctttcttctacttagagtgaacacagaaatattaatgtttgattataagattccgtaccaagctttttggagttattgctatgtatttgtaatattttattactaagttttgaaaatttttaaattctgaaacacattagtcctcaagggtttcagacaaaggactgtggacctgtaggtttgagagctgattgcttttttctgtctaatttttcaacaaggaatagtaagcagaaacatctgcctctgctggttctttgttaagtctgagagatcatccgggagtccagtggtctgtgtgcatccttctattgtcattggatgccctgtcatcgaatttcactccccagctctcaggctttgaaggttgtcagaatctattttctcacaattagcattctttaattgagatgtgacataaggtagtatgtggggacagactgctacagtggaattccagttctgcctcagtatcttaaatagttaaggacccacaagaatcaatatattcattcattcatttgtttatttattttttgagacagagtgtcgctctgtcacccaggctggagtgcagtggcacgatctcagctcactgcaacctctgcctcctgagttcaagtgattctcctgcctcagcctcccaagtagctgggactacagggatgtgctaccatacccagctaattttttttgtattttttagtagagacggggtttcaccatgtatgccaggctgctgtcgaactgacctcatgtgatccgcctgccttggcctcccaaagcactggtattacagacatgagccaccgtgcccagccagttttattttattctgagatggagtcttgctctgtcactcaggcaagagtgcagtggtgcaatctcggctcactgcagcctccacctctcgggttcaagtgattctcctgcctcagcctcccaagtagctgggactataggcatgcgccaccacgcctggccaatttttatgggggtttttttgtttgtttttttcttttgagatggagttttgctcttcttgcccaggctgaagtgcagtggtgcaatcttggctcactggaacctctgcctcctgggttcaaatgatgattctcctgcctcagcctcccaagtagctgggattacatgcccggttaattttttttttttttttttttaatttagtagaggcagggtttcaccatgttggtcaagctggtctcaaactcctgaaacctcaggtgatccacccgcctcagcctcccaaagtgctgggattacaggcatgcaccgcacctggccaatttttgtatttttaatagagacgaggtttcaccagattggccaagctggtctcaaactcctgacctcaagtgatctgcccacctcggcctcccaaagtgctgggattgcaggcgtgagccactgtgcccagcctcaggacatttataaatggatattaacagcatttagaatagtgcctgacacatgggaagcactgtttaagtattagctattattattaatggagccaattttcccttgattccttgtataaaatggaaaacctgctcctctttcagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaaggtgggcctttttttaatgcattggctttttgtgtagtcaggaaatataattaagctctgaaataataacttcatgtgccaatggtatgttaggagaaagatgctagcagaaagctggcttcctggctcttgagtagttataaaaatacagactttatatcagctgcccagttactgtgtgttacccaactcctgaatctaccaaaatttgataaacaatttggaaggacaaacctacattttttttttttatgagacggagtctctctcactctgtcaccaaggctggagtgcagtagtgtgatctcagctcactgcaacctctgcctcccgggtttaagcaattctctgcctcagcctcccgagtagctgggattacaggcgcgtgccaccacgcctagtgtatttttagtagagagagggtttcaccatcttggccaggctggtcttgaactctcgacctcgtgatccacctgcctcagcctcccaaagtgttgggattacagatgtgagccactgcgcccagcccctaaattgttttagtaaagaagaaagcagttgactttttagaaaaggaaatgtcttcttcctttgacacataacctcaagatggttaggttacgtgataaaaagtgaagctgcttgttactggagcctctctgaattgctggtgaccactttgcagtctgaggaagacgcaggtgcaagtaagttaccaagggtattttgttttcattccaagtctctgatgacatattccacctagctcttctagaaaagcttatttgttaactagtgttagcaaaaataaatggtgtggttaacaaatctcaggcatttgacagtagctggagaaatttgttcaaggtccacaagagatgaggctgggctacaaaaagaggcctctggccgaagatggataagagatcacaagtgaaaggtcagaagtcactaggccagactctggctacctaatccctgaattaaaaataaactcaaaatggggggaaaaaggctaagcatatagttacacaggtagtaaatacaaataaaacgatatttttgcatatttaaaatactggaagaaagtacaccaaacttgtgggtgaattatgggtggttatttaactcgtttagtgaaaagcatgtatttttatgagcaggagaaaatagtaaagatatacccacattctgcaggctaaaggagagccctgtgtgtgttttaaaagcccatgtttccagtcaaataaaaaattaccggggatgagctggtgaaatttaatcgaaaggtgatccattgtgaatgcaatgggagggaaggggcatgtgggactgtgtatcccaaaaaccctttgatagcctatgtccacagccatctctggaaaatccagtctaccatattcagtcttgagttttctctgagaaaggattccttcgtctttgcagcagcaggctaagttggtactctccacagattcttggaacaacaacccaggctctaaggaaacatctaggcactaaattgaatgaaagagtgatggctttttattcaaataaaaaaatttcaaatctgtcaaaacagcacccctcggaaaactaaaatagagatatttcaagattttataattttcaaagacctttgaaatattttaaacttgtgaaaagttacaaacctgatgtgttgtctaaaagcgtttttcaaacaagccagtagacttgaaaaatctagtctgaagcacagacttaaccaatatttgctggggatatgcccccaaatctggccataaacaaaatctctgcagtactgtgacaggttcatgatggccatgacgccatgctgaaggtttaccggaatgagagcaaggaacacctggaccacccagggcgggaaaacggcttaaaggcgttcctaaactacaaacaatagcatgagcgatctgtgccttaaggacatgttcctgctgcagataacta

SEQ ID NO: 14476 - DNA, 20441 bp, Human
  misc_feature (1)...(20441): n = A,T,C or G
ataatattaagtctaaaaaaatacatgccttaatttaaaaacacttaattgctaaaaagtgctaatgatcatctgagtcttcagtcagtgcaacttttgttgatgaagattctcatatcaatgttgatggttgctaactcattttggtggtggccgctagtacttagcatggctgtggcaatttcttaaaaataagacaacaatggcatttgccacatacattaacccaccctttcacaaaagatatttttagcatgcaatgctgtcagatagcattttacccatagaagatcttctttcaaaattggaattaatcctctcaaactctaacgctgctttataaagtaagtttaagtaatattctaaatctcctgttgtcattcaacaatgttcataacatcttcaccaggagtagattccatctcaggaaacaagtttctttgcccctccaaaagtagtaactcctcacttatttgttttatcatgagatttcatcaattctgttacatcattaagttccacttctaattatagttatctttctagttttattatatttgcagttacttattccattaaagttttgttataggaccaacagtttcatatgcttactgtccaataatagtccaattacactgagacgtcagatttggcagcaaagaaggagtttaataattgcagggcactgagcaaggagataagaagagaaccctaaatccagctcctcaaggagttctgggttggaggttttaaggagatcatagatggtgataggctggaaaatttgggtaattgattagtcagggtaatagggtaaagtcatcagaacaagaaactacattatttgctgagtcagttccttgtggggtcctctagatcagctggcatcagtgaagtctttcagatcagctgacatcagtgagatccttcagaccagccgagtcagtagttttagcagtatgctggacctgaaggaatacctcaaaaggaaagttgatcatttcataatgtttaagttaatatttatagaaggattaagaggaactatagtcttgtaacagggtctgcataattctaggacaacagccaaataactgtgaggaagtgagtcggagaacaagctaacctaatgattaatgctgaatgtactacaagcttggtttacttttctctttttctttctttatctttgattactttaacaaagtttaaaaagatagtgtcatcttgaaactctcaatatcttacatgatggttgtaagaatcaacatgtatacgctatatcataaatgaacctttaaaatattatgttacataaaagaagccagtcacaaaataccacatattgtatgattctatgcattaaaaattgtccagaataggcaaatctatagagatagaaattcaattagcaattacctaggacaggggaaatgcagaaactaggggtggagagaaaaaggctaaggactatagggcttattttggggagataaaagggctctccaactgattgttatggtagatgcacaattctgtgaatatactatgaaacattaaattttacacaataattgataaatagtatgatatttaaattacatgtcaacaaagtttacaaaaatatgtggaccatgtttagtcatttaatctttagttttgtgtcaaatggactgcagaaacaagatctgtcactgctactgttctggacactcttctaaaatatattgcataagacagatggcatgtccatacaagatccttgatattagctgaaggatagcactcataaacataaaagggaaattaatcacatctgtgtgaacagatcatttaccttcatttgtctctttgccatccacatgctcagactgttgatttaatgatattgtatgtactttgacttataagggttacattttaacttcttggctaatttatctttggacataaccatgagaaatgacagaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaannnnnnnnnnnnnnnnnnnntggtcagaccttccaaaagatacattttggttatatttttcacaagtacagggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggtaagtatttttttcaatcagtaacatgaagctctaacttatttgtgtctttgaagcagagcttatataaagccataaagtcagggtagtggggttttggtaagtgaatttataaaacaaaaatacaagatgatctattaatctcacaaatattatagaaaagcttaaattacagggtcagttaaaaccctgtggccatcactcacacagaacaccccaggaaatcataaacctatacattagtgcatctaagactttaagcaattacacatctgttttactatacattgttttacatcttaaaaacagtaaaatccatcaaataacttcttactgaatgcatagatttagaatgagtagttacacatttttctacaactatctatataactgcagaaattgttttttcttgtaaacttgttttcttatttagaaatcaaaagatgttcccatattaccagaaggtttccttcacagtaaagagagataatgtctatacctcagatgcaaaaatcaataagggcaatttgaagtttctaatgtttctatactctttcacgaaagaattggaaatcattaatttaaagtccaatcatcttgttgaagtgtgaaggttgttatatctacatagttttttgaaactatgtctctttattagaacatatgagacaaattaaggttgagtacaaatttttatttcaataatttctcaaaaatttctagctataatgtacaaatatatttacttaaaaatattattaagatcttagcttgaatctaaaagagtagttggtacaaggatttcagccatactctcaacatagtccacagttcacttgaaccaaagataaaagaattagcttaatgagttgtgtaaactagactatttcttagaaaattatttttatgggtagagtagaattaattgattatggagctcaaagagttgtttaaatgtccgtatgctactattgaagctttaagagaaaagaaattttctgtttaactttctatggctcattttaataattgtttatgattatgagcatactgatgcgacattagagatgtagcttaacctcacaattctcctactactttgtctttcttataaatacacatgggcaaaatatgtaatacataaaattaaattatatctatatatgaatatgtgtatatatttttcaaagcacagatatttgcctacatttttgcctacattattctaacccctttcagaaatttacctaaagtaattatcttgtgtcatccaccttttttttttctattcctgtcaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggtaaacatacttttgttggttttattttgttggctttgaattttcagtagaaatgattctatagtcttctttcagagtgtttgacttacactgaaagaaagatgggaaatgggtggggtaaagcagataccaattagaaactcatgtgcacgttaataccatcacacgtatatgagttttatgagtattacaaatagagaggaatactaaggagactttgaaaatagggttggttaaattaaagtcttcattatgcaatacctaagaaggtattggtcatccaatcaaataatatttacaaagggattagcacaaaacacaggtaagtgcagaattttcagagaaaaaaatagacacagtttctgtccccacataccttacattctacttcaaaagatagaatatgtgcaagtaataaaaattatataaaaactattatctgaaggaaaaacgcaataccaagaaagcatcagtggagataatagaaagtatcctgcagtcactgattagtaagatgagagctgaacaatatgcaggaataggtaaaagaatgacggggagagacagacaaaaaaaaaaaaaaaaaaaaagaagcaggtaaagtggtcaggacagttctcaagtcctcaagtttagtttgcagggagagactaagactcggatgatggtgagaggcaaattagagccagatacgtattaggagttgaaatatttattaagcacattgaaaaactactaaaaagattaagaaataaaaatatatgaaaagattctctttttaaaggagagctttcaagatattcaatggattaaattgcaggagggccagactgtaaagagccaaccattcaggaaattttgcaggattcaggtagcagatgatggaaaagtcgactagaaagttgatagaaatcattatgcccacatttacaaaaatagtggcaacttcatattgtgttgagtggaaaaatattaacacagacaaaacacttaaagtgtctctggaatatagtcagtgactcagaaatattattaattttgcaattatggctattttgttattattactaatactactaattacttaacatgtgctggtcacttgagatatcattcttcatttaatagaaccagattgttcagtacatcaaaattatattctcttgcagagtcatagttgacagataccctgtggacttgattaaaagtagacatatcagttttgacagtaagatgagctacttgaaattctaaaattctaccataggtaataaggatcttcaccagtattgcagcgtaaaacacttcctcaacaatagaaatgtgttcctttaatatttgcagacaaacttagtgttcacttgatcttactaaagcatttaaatcattcttcattgagaccccagagatttacatattacagcataaacataccctatgagagcagatgatttttgccgtatgacaagcaacttattaaagcttcctgtgggaactcgtctcaacatcatagctgcctgacacagaagcacagagataatgaacaatgcatgtataataaagcacaaataatttataccacttgtatctgaatggcgcccttagtttagattccagggaattctgtcagcatataagattatattttttatgaaggaacacaataaactcatatattttaaattaatatcacacttttaagacatatgtacaaagcaagcattctttgttacgttattatttaatctcttaaaagatcatttttgtctacataaaactgaaattttattccattgttaaaactcaatatctatgttgaatgaaaattgtatgggctttatatgataactttctcaagagacaaaagctgaggtaagactaatgaaaaatctatgccaccctaccctactcttgaaaaatttccccacccatactaagggaaaaactgatagtgtcagtaggagggggaagagaataggaggtgtagaaggacaagaaaagggatgactagcactaaaatagtgataattactactactagctgttgttattaacttgcagaaagatttgaatgcaagtcaatggttgtgaaacccgttcttcgtttattatgtaaaataattgctaacccaggttgctttcatttcaattaaatattaaattctaagataatttcttataagagaaaaagacacttgacaaaatgtatcaggtgttttaaaaatgaatattgctatcagttttataatatgttcacgtgaaatcatacagagaaaaaaattaatcaaggtgtacctattaaacattatggaaaatattcataaaattaacattggaagtaatccaacatcttaaatgaaggaatgattaaaaacttatactatgtgcatacaatagcattacaataattttatcaatgaaatattcaactacactgtcagccatattacaaataaagtgagttagaaaatgataaatataacaagatgacaagtttttgcaggaggaaaatgtatacataataagattaaaattatctaaataagtgtcacatgtgtacattgagctatgtaaataggacaaaagccatgatgaaaaaatatattttacataaataatatcacaacataaaaattttagaaaaattttatttaaaaaaatttttttcatgcttttataaaatttcttacattaatcttatattatttttattatgttatcacagaagaagaaacaaccagtccatatcagtgatgaatctgtaaagaggctcgattccttcaacactgggtggataaataaggctctgggcatcaagctagtgagatgaaacactgaacaccagttacattaaatatggctacaggcaactgcaatcacacgcaatacctagatgccccaagtattacctggaatagcagtacaatgactctcatgttaagattaaaaatcatattttaaaaaaacactctgtaatatgtggtctgcagagttaacatttggacttttttttctttgttttgtgaagaacagttaggaaaagttttaccccaatcattaaatctgaaagtatttaaatttaaacatcggcatatattggacaacgcaagtcagaataattctcaatcgattgcagccaagcacatcttcactaggaatgttacgtggtgtgtgtgagctactcaaaaaagagacaagatctcccctgcagaaaggcctggtggcctcttctgttctggtgcaagtgctgcctctgagacacaacaaagtgatgatgagagttcctcacatgcagttataaacagcacatcaatttaacagtgtgatttcagggaaaagttattccacctaaagaatcacctgaaaaatatgatcattcaactatgtaactatatacaattctgtatgataaatgagactcctggactaattcatagaaattccaaattacattaccagactccagaatgtcagcggttcttaaccaccagcttttatttattttattttttttagtttttgaaaaactaccagaaaactctgacaaactttaagtgaagtataaagcattgtagagaaacataaatgtagatataaaattatcccaactgtgagtagcttatcctcagagctcatagttagggaagtaaaccactaactgtttccaactaagagaattctacagaaaacctgcctgaaataaacacaagggatttagtagaacaacaatatagaattaaagctgagtggtcccactttccaagaacctatattagtaactttagtattgtaagagaagagtctgtgtataatatttttaacattatctccctgacaacaatgtaatagctccatttcttttctcccttacacacatgcacacaaatacatacacatacacacatatttacacaaatatccttaacagcatccacctatctcatattatacatctacttgcaaaaaaactgagtgattgggtcagttaaaaaatattatttactccaataattcctcaaaatactgggattttctctctttagtaatttgcaccaattcttttggtagtgcccgctgtgctaatactcttttgtgatgaagcaaattctttcttcacaggaaatggaagactttgtacagagctctggagaaaatggtgttgtggtgttttctctggggtcaatggtcagtaacatgacagaagaaagggccaacgtaattgcatcagccctggcccagatcccacaaaaggtaagatgaagtgccttactggtgtggaaaactactgaaagaggctgttaaagtttgaagtaatccaattatagaaacttctgataaatgtgaagttgaccaaaagttgaaaaattagaacaaggataatcttggagaaactatgagaagtttgaaaattgtggttgcatttttttttaaatggtgttaagtatgaacattcccctatgtaaatatgctgacaataaattgaatggagaaaggtatttaaaaagtgtttggagacttctcacctcctgtccataaaattttgaattgtgtatgtgatctacatagaaagaatattaaagagtagattgaactcttcatagctgaatatagccttaaatatgcttgtatagcatccaccgacagaagtaatagttgtgcctcagacttaggggttgcatgtggccctggaggagttactacccttggtatgcatgagtagttcctattagcatcagtgggaactcagtactccatatgtattcacaaaaggcaacttgagacccacagttatttttaatttctgatattaacactcatacatactgctgaatttaactcaatatatttcagttaagtgaaaatggtgcttaatgtagtctttagaatgactttcaggtgttttcacaaaaaacgtatatccagaactgtgtccttttagaaatacaagtaaaatttttgataattagcttcaaaacagttttcctaatctcagcagtatccaatgagtgaagaacacttgactgactcttgggtcacctctattacttattgtactctggaagctcttggtgaatgtttacgattatgggatgtagtatttctgtttgcactttaagtcaaatgcttgtataaaatacgtgacaacaaatggagaatattggctctgttagtagttatgcggtatattctctgtttaaggatctgtgctagtataacatgattgaatgttattaatttaggaataataaccaacacatgtgaggagtaggggactaaggagaatgaattccaatcctgtgattaaaagtgtaaactataggccaggcacggtagctcacgcctgtaatcccagtattttcggaggccgaggcaggcgaatcacgaggtcagaagttcaagaccagcttggccaacatggtgaaacccgtctctactgaaaatagaaaaaattacacaggcatgttggcacacacctgtgatcacagctactcgggaggctggggcaggagaatcacttgaacctgggaggcagaggttgcagtgagccaagatcacaccaatgcactccagcctgggcaaacccctctcaaaacaaatgtaaactgtagattctactgtagtatatttcaggatctagaagtcttatttttataaagatggagtctggaagatattgctaatgtattttacttcaacatagggaacaaactttttaagtatattaataaatattcccgtatggttagttttttacatttttaaaaataaactttatggatatgacaaattaaaaaaaagaaacttcctgcctaaaaatttagctgatgggaaagcaataattttctcagatattagttcaaaatcaaaaatatacattaacgatgctaaaataatacagagggtgtttttcattgataataaatttggcattaatagtatgatcaagaataaatttattcaagaaatgtaggtgaagttttggtattgccatgatattggggtcaggtaagagatatcaccaaattctgcccctgtcatttgacccttttgtttaagaattccttagggcactgtacacactacaggtgttatcagaaaaagttacattttaatgggtaacttcactaccacaataacaatagcaggtatttcaaaaagtctgacatgcatcatgcaatttagtcttggcatgtaatccagcctcttgtacttcctgtacattttggaagaggtgtatctgagtaatgttcagggtactattcagagacagaacagcctaggcggacagacaactatcccaagtacccacatagccagatagatttagagaaagagaaaaagcctgccctgctggactgcgcccagccaatgtctgaagcaggaagatgaaagggtggagatggatcctgccctgaaggtggaccctgtgcagtataaaatgtggccccacaaggactctgcactatcagattaacaactcctcccaatggaggaagcagaaggaaatatagaagggagtcaaacagaaggcggccaggcacagaaacaacttcagataccccctctataaaatatagtagaaatatattatcttttatatagaataagccagtgacctttgtgtatttgtcaattactttttaatttcctgcctgataaagctttcttgtaatgacctcttccaacttttgctgaaacctgagttactttaacactgatgtagcaaataaaagttaaacactgtaaattattgtttagtttatgaggattgcttgggagtttcaaaattagtaacttaaacataaaatgtcttggctatagcagaacatgttaatcactattgtcaaagctttgtagcacgttgtctcagtgttaataatcagttaaccaaattcagcaagatacaattttgagttttttcaacagctgtgtttttattcatgacaccaacagattcttcatttctatgctgaaaaatatccaaaattagaaatactgataatactctgaatttgtgtcaaaaataaccacctgaaatttattttggaagtagtgcttgataatttataattccaatgaagttatacataaaacctttgcagcattaatctatttcttataagtagcttatttatggacttgttattttgtcaatcaaaggacaacaggctctaatataacaacctacacacaagtagatacatgtgaactacttcccaaattactcaaaaagatatgaatacattaaaattaaatttggaaaatgaaaactaatataaaatacataaaacaaaataagcacgcaggtcattacaaaattgttactattttttacactagaattataaggaatagctaaaatttttatacatttttagaatatttttaattttaaaaaattaaattaatttaacttttatttgtaacttttattttaagttcaaggggacatgtgtagtttttttacataggtaaacttgtgtcatggggggttattgtactgttcgtttcatcacccagatattaaggctaaaatcagttaattatttttcctgatcctcccaccctccaccctccaatacaccacagtgtatgttgttcctgtctatttgtccacatgttctcatctttcaccttccacttataagtgaggacatgccatatttatatttccatccctttgttagtttgctaaggataatggcctccagctccatccatatccctgcaaaatacataattttgttcttttttatgactgcataatattctgtagtgtatatgtaccatattttctctattcagcccataatcaatgggcatttaggttgattccatgtcgttgctattgtgaaaagtactgcaattaatacacctgtgcatgggtctttataaaagaaccatttatagtccgttggttatatacccagtaatgggattgctgggtttcatggtatttttacctctaggtttttgaggaatcgccagtcttccacaatggttgaactaacttacattcccaccaacagattataagcaagccttttctatactacctcaccagtatcatgatattttttgagtttttaataatagccattctgactggtgtgagatgctatctcattatggttttgatttgcatttctctaatgatgttaagcttttttctttttttttttcatatgatggttggccacacgtaggttttcttttaaaaggtgtaacaattttttaaatgcttgaaattttcattgataatctgattttttctaaggtactattttggaaaatcatgatttccttatatacctaactaattataaaagttgagaaaattaatgtgagtattctatttacattagtctttaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctgtataagtggataccccagaatgaccttctaggtaagactctggtgaacaaatactgaatatattagtaacagcacattagagtgttaatagttcttcatgaaacaagcttattgaatatttgttaaggaaaaacaaaatgtaacttctttatattgattttccagtcttaagggagaaagaatacattataatttttggcattttatgatatacacccacattctttatagtctgaatcgggggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaatttttcattagcccaactggaaatcttgtattgttttgcagtctgaagtcacacgcaccgtatagccttcagttacataccgagtacaagtacgtgttttttcctctgaagtctgaaacacaattttaatttagttcagtgttttagctggaaaacactgtcactttcagagcctttcattgtgcatctcattttattcctatgagtaattttgctaaaattcatccaatcctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcgtgagtagaacaatatttttcactaggtggtatttacagatagcttctcttgtcaatagtgagtgtgagtttcatcctttttataagagactaattttgaaagaatttaaatgatttaaccaatctgaaatctgcttttatttttataagttatttaaaaattgaatttgaaacacatacatctaaagaatagccagttagtgaaacaattttctacacaaaaataattttaaaaggatatagataatacaaaaaatacatttcttaaaaatttgacataattaatccatagaagaaaggaagaataaacctgaaataatataataaaatattttaattagatatctaaaacacctcagagtataaccattttcttgctgaaaaattaacttttattattatcattattgtaacagacttgaaaatgagatttaatttttatagcataaaacccccctgtttatgttataaaatccaaatatatttagtatgtttacagagccatgaagccatcactattacataattttagaacatttttatcaacacaaaagaaactgcaatgacacagaagtcacttcctatgaccgcttagccctggtctaactaatttgtttcctttctctatagattattctctttagatatttcatatgaatggaatcatacagtttagggtgttgtgaaatgacatttcacctaggctaattttttgttgttttttttttctggttttagtttcattcatgttgttgtgtgttttaatacttcatttctttttatagcagtttaatattttttagtaaagatatgtcatattttagttgttcacttatcagttcattggccttttgattgttttcaattgtggctattaggaagattgctacacatgtttttgcataaacatgttttcctttctttagggttgatactataagtggaattgctgcttcatgtgggaactgtatgtttatgaagaactgctaaactgtcttccaaagtacttgtttcattcatgactaccaccagcagtacaacatggttccaattcctccatacttttgccaaacctgttattccctgactttttgttacagccttcttagtgggtgtaaaataatctctcatcctggtcttggattgcattttcattacggctaaaggtgttgagaatcttcatacgtgcctactgatcattcatatatcttctttgaaaacagtctatccaatccttggaacatttttaaactttgctatttgtcttattattaagtttaagaactatttatatattatgggtcatgtcagatatataacttgtaaatattttgtcccactctgggtgcactaaattttactttttgatgttggtctttgaagcacaaaaaatataattttgttaaatttttaataattgattttttcaaacccaaagatatcaatgtgcaaaattccttgtggagtccagctaccatcaattcagcatttatagctactatcaataatgtttttttatataagcagggtatcatctaaaggaatacttgaaaaatactttatcacaaaaaaagaaggataatgaatgataaaaatacctttaaagaagataggaaataattgaaaaagaacacaaaccagcttggacaaatagaaaaaaaatatataaagcaaattggtagatttaaatatgattatacaaatactttcactcaatctaaacagactttagaaaagagcaagtaattagtaaagacataaaacatttgaagaacacaattaacaaatggaatcttataatgtaaaatgatacaaacgcacatacatacacacacaataaacatatatgtatcatatatatcaacttgaagacacattttcctagagcatgtcgaatagttatctgaagtgatatgtggtgggcaataaatcaagatttagtacatataataaggttcaatatcataaagactatatgatccagccatagtggaagtaagggaggttataaaaactataactaacatatctttaaattttagagatcaagaggtgaatcacaactatgtctccacttttatctcaacaattctactcccagttatatacccaacagatatgtataaataaatctaataccatatagaatatttatgacagaattatcaatactgtccaaaaattgttagcaacccaaatatctattaatcataaaatgaagacataatctgtgctttatcaatcaacagaatactacacagcaatggaattacccaacaactgctacattaaaaaaagacactaatgagtacgtattatataattcaattacataaacaagcaaactaatgtatgctattcgaagtcaggctaatccttagttggtggacaaaagtggtgactaaatggttcagaaaaagagagttattctaggcaggttgtgatatcctataccacaatctgaacagtaggtaaatcgatatcttcacctcaagataatgttcaagatgatcttacatttttgaactattcacttagtgtatgaatatttatcttttgtatttaatatttaaatgtttattttatgagatatataatgcattttaaaattctaggactcaaatagcaaaataagcacagaaaatagagaaaatcctagtggttccatcataatgtggccagtaaaagcctctcttagaggtaacattagaaggaagccacaagaagggagagaagcattccttgggttgtagcaagagagagtactccaagagcgggagagaggggaaaaaaatgtgtaaggtactaagatgagaacacctttgggagcttaaagtaaaatagaaggccaatctagaagacagtgtgcaggggaaaagtgttaggaaaagagtttgcccgtgtctaaaaatgtagggttctgtagaccaaataacagagttggattttattctaaaaataatgagaagccaggcaaaagtcttaatcaggggagtgctttaaactgactttaattgaaaaaatcattctggctacagggtgggaaagagtaggagacaaaagagtaatgtagaagcaaagtgactagctatgaggcacgtcactcaccatgacacaattactttttcggaacttagagatgataattctcatattgcattttcacgatctttctcatagcacttaaaagggctcatgatgttgagcatgttctccgtatgtctgtttgagaactaagagtgtaattagattgttcataatacaaaggataaatgcataagggatgaatatcctattttccatgatgtgattatttcatattgtatcaaaacatctcatataccccataaatatatacacttaatatgtaccctcaaaaacttaaacaattaaaaacaaattaaaaatgccttatattttctctgcttcaaaaaaaattaactttctcagctaacattcaatttctactttaaaaatatttctcaatgagagaagtccaatttaaaagccaaactttctatgatgactcaaattaaaatacacaaattcgatgtcaattctttgacatttattttgaattatttggccctttaaaagcctttcgtaaacttgatatggacaggcaaattaacttactttcagtattagggaggagaccatgcttcatatcgtcttatgcccaatttctgcctccaaagaaagaagtaaaaactaaaaggcagaaatgaaatccacaagcagacagcccagtgccacaccctgtgcctgatagttaaagatcgacccctgacctaaccagttatgttatctatagattccagacattgtatggaaaagcattgtaaaaatccctgtcctgttctgttccattctgattactggtgcatgcagcccccagttatgtacccactgcttgctcaatcgatcatgaccctctcacgcagacccccttagagttgtgagcccttaaaagggacaggaattgctcactcagggagttcagctcttgagagaggagtcttaccgatgctcccagccgaataaaacccttccttctttaactcggtgtctgaggggttttgtctgtaactcttcctgctacattactgtctttatttttatctttcagatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagccttatgagctcgtattgaaatttgttgaacttatattgaaatttgttgttctaattcacagtatactcacaaaaaaatttactcagcttaactatatttcacacattgtacataaacacaagatcattaagaagtccactgacagtatcagtactgttttgcacatactcagaataatttggcttcattttgaacaggattgtattgttttaactgctgctaaagaaactattacatagttaaattgtacagaaagtctctcttccttttgatattttaagatgagtagtattgcttggcttttataatgcatgcagctttattctcatatttttcctaaaatttatggccaagtgtttactgttttagagcttaagtcatttctcagtggaaattatggggaattagaaatacagcaactcttaccttcttcctactgtaaaattgaactattttgtaacatctttggtttcatgagccaattctattttttctagatatttaaaaatatacatctggttgactttattctcatatttttaattatttcaatagttatttgggaacaggtggtgtttgattaaatgggtaagttctttagtggtaatttctgaggttttggtgcacatatcatgtgagcagtgtaccctgcactcaatgtatataatcttgtatccctcaccccctcccaccctcccctctgaatcctgagagcctattatatttttcttgtgcctttgcatcctcatagcttagctcccacttgtaagtgagaatttatgatgttcaattttctattcctgaattacttcacttagaataatgctctcccactccttacaagttgctgttaatgccattgctttgtttctttttatggcttagtagtattccatggtgtatatatatagtatgtatatgtgtgtgtgtatacttgtatatgtctatgtgtgtgtgtatatatatatatatatatcacattttctttatccacctgttggttgatgggcatttaggctggttccatatttttaaaattgctaatagtgctgttgtaaacatgtatgtgcatgggtctttttcatataaaacttttcttctgggaagatacacagtagtgggattgctggatcaaatggtacttctacttttagttcttataggaatcttcatatggtttttcacagtatttgtactagtttgcattcccacagcagcataaaactgtcccctttttcccatatccatgccaacattgtattacttttggatttttaaattaggccattcttgcaggagtatagtggtattgtgtctggaattggtgggttctttgtctcactgacttcaagaatgaagccgcagaccctggcggtgagtgttagagctcttaagctggcgcgtctggagtttgttccttctgatgttcagatgtgttcggagtttcttccttctggtgggttcttggtcttgctggctcaggagtgaagctgcagaccttcgcggtgagtgttatagctcttaaggtggcgtgtctggagttgttcattcctcccggtgggctcatggttttgctggcttcaggagtgaagctgcagaccttctcgttgagtgttacagcccataaaagcagtgtggacccaaagagtgagcagtagcaagatttattgcaaaaagcaaaagaacacatcttccacagtgtggaaggggactggagcgggttgccactgccggctagggcagcctgcttttattctcttatctggccccacccaatcctgctgattggtagagcccagtggcctgttttgacagggcgctgattggtgcgtttagaattcctgagctagatacaaaggttctccatgtccacatcagattagttagatacagagtttggacacacaggttctccaaggccccaccagagcagctagatacagagtgttgattggtgcactcacaaaccttgagctaaacacagggtgctgattggtgtgttt

SEQ ID NO: 14477 - DNA, 20599 bp, Human
atttttaatgaggcaggctggagggctgttttttggaattgaggaccgggagtttcccataatgaagggtagctcgagagaacagggaaaaaggagaccatcctggacagctggagggagacgataaaaggagttatcgtctccgctgcctttttggttcctggaatgggatgaaatggcttagaggcatccccctaagaccagatgaccagcgagtgcctggcgcacgctggcgccttcttggatcagtgttggatttttggactggagaaaccaagagaggccatgtagattttgccctgttaaccgggctccaagggaaacttaccagtaggcgagatcagtggctgatgcgcatgcacagagaggcgactggaggctgaggagcttcctctgtctaattgctgtggcctgctctctggggtggagggataggtccacaagcgacacagacctgagcccctcctaggatttggcaccagatgtaaggttcttgaatcagtttgaaccccaacagcgcgccaacagacaacaggaggcggtgtggagcaacatgctgttttaatgaacgcctggttgcaggtgggctgaggcctaaaatggcatcagccccaagtgaggatgggacaggggttttgtagtcctctgtaaacagtaagtgtcccagtctgttgtgactgctatgtagtacctggatggcctatttcttgatcttcaggggtacatctcttccagccagggtaagtgtcttctggccggctctcttcctgcttctgctatcttgctgacacacgctgctgatgcaagtggtcttgcatcttggggctgggcctgagaagggaggagttactcatcccttcaagccttcaggtcctgaggagaatctttgaaccccctgcatcactggccaccctcctgatagatccctgtgatgccaggcaggaatgagccgcttgggtatccagagagctcccagtgcctttctgctacttcctctacccctgtattttgcttggcttggttctctaatttgactcagcttcacataaagtcaggaacttctcctgcaaacagaacttcagcttctccagtggggatgtgtattctggagagggggatcaccctttcccacttccattgttggggcactcacagtgtttgggatgtctcccaggtcctgcaggagcagtactcttcctgcagagggtgtgtggatcctctcagaattgctggtctgttcttgcagttgatctgcagctaaaattcacaatgcaagcctctgcatgctgctctgtctggagctgcaatctagtcctgcatcccatctgccatgatcactggaaaaccctcatttattttttaaagggtccagaaaatgctaatctatagagatagaaattagattagtggttgcctagggtaggatggatgcaaaatttcagagtggggggttagaggctattgtatagaatcttttggagataatactgattattgtagtgaaagtaaaattctgtgaatatactaggaaacattgaactgtacacactaattggtgagtcatatggcatatgaattatgtgtcaacaaagttttagaagacattacttgcaccacgatattaaaaaatgccgtttgagttgtataattacttcttctctctatgtcaagggcaccgaacaggcaggagcctctcacttgccactgttcttaacagtattataaaataattacataagacaggttacttacatattctaggtcataaaaattattgcttgactagagtaattgtaaacataaaagaacaccaaacacactaaaataaatatgaggtcatcaatcttttgttggtctccttggcatgcacctattcagactgttagtattatgtatttacttcaaattttagcagttatattttaacttgattgatttttcctcagatataagtatgagaaatgacagaaagaaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggtaagtcatgtgtctaactggtgcttattaagttctaacttttctgtgcctttgaaggtgagcttatataaatataatgtcagaagatagtgtttttaagggaaattatgaattgcaaatgtaagatgatctatcagtctcaaaaatattatagaatgttgaccttatagaatcagttagaaccctggggccatcactactacaggacacccagagagtcataaaccttcattgtaaagcactaatgatttctttaaactatcacatatcattttgctatacattttttcatctttaaaaaaagtcaatagatacctcaagaaacatcttcatgaaggcagacacataaatttagtatttacacatatttctagaaaaattatcaatgcaggattgaggaatttgtttctctttgagttcctcagtttcctcatttagaaattaaattttgtttttcatgtaagaaggattccttcacagttgagtaatatagtggctctactccagaaacagaagcctaaaacttgagatttctaatgtttatacattccttcaataacaggttgacaattatttctttcaaaaactgaaatcttgttgaaagtgaacatctaagttttaatctatattttattaaactgcatctctccatcaaagaaaataggggccaaattaagggagagcacatatctctatgtcaataaattctgaaaatgttttaattctcatttgtaaatatatttattttaaaaatctaattatattaagatcttaagatgaaccaagacagtagtaggtgtaaagatttcagtgttgagctcaaaaaactcatggtttactttgagaaccaaggatcaagggactagcttaataaactgtagacactagagtacttcctggaaagctgttttcatgggtaaggtaagatgaattaattgtggaactgaaagagttgtttaaaggtatatttgttactattgcagcttcagagggaagacaaatgtgtatttaagttcatagtggctacattagtccattctcacactgctgtaaagaaatacctgagactgggtaatttataaagaaaagaagtttaatagactcagttccacatgactgggatgcctcaagaaacttagaatcatggtgaaaggctaaggggaagcaagcttggatcttctcacttagtggcaggagagagaagtgcgagcaggggaaataccagacacttataaaactatcagatctcatgagagctcactcaatatcatgagaacagcatggaggaatccacaccatgatccaatcacctgccactgggtccctccctggacacatggggattatggggattataattcaagatgagaggagatttgggtggggacagtcaaaccatattagtgacttattttaataattatttatgattgtgaatatactgatgttacattaaagatgtgatttcttcttacagatctctgaatacattgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggtaaatgtattcttgtttcatttgtttgcttgacattttcagaaggaatggctggatatgtttctttcagagtgtttaactcagagtgaggggaatatgggaggtcaaaaaaaaggacttgccattagaaaatcatatatttctgtagtatcacaagtatgtgaatgttattatcattaaagaccaaagaggtttactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagaaatatgcagaagagatcccaaactcattgacaattaaagtgagtactcaataatgtgcagagataggtgaaacgatgaggggatgagaaacacccaaaaagaaaaccagaggccaggcaaagtggctcacacctataatccctgcactttgggaggcagagaaggcatgattgcttgggctcaggagtttgagaccagcctgggaaacgtggtaaaacctcatctctaacaaaaataaaaaataaaataatagccaggcatgctggtgtgtgcctgtagtctcatagtcgtagctacttaagaggctgaggcaggaggcttgcttgagtctgggagcagaggctgcagtgagctgagaccacaccactgaactctagcctgtgcgacagagcgagactctgtctcaaaaacaaacaaataaacaaaaaaaaaaaaagtaaaggcttgcattaaggcagaaaagtagaaaagcaataagggcagttcccaggaactccaaatttaatttacaggaaaaggttgagtaaaagtcaatgatgggccgggcgtggtggcttacacctgtaatcccagcactttgggaggccaaggcaggtggatcacctgaggtcaggagttggagaccagagtggccagcatggtgaaaccccgtctctactaaaaatacaaaagttagccaggcatgttggcaggtgactgtaatagcagctacttgggaagctgaggcaggagaatcacttgaaccccggaggcagaggttgcagagagccgagatcacgctattgcactccagcctgggcaacagagtgagaatctgtctcaaaaaaaaaaaaaatatatatatatatatatgtaatttgatatacccatagggacaatggagagctactgaaaagagtgaaaagagttaagaaatgaagagatatgatcagatttccttttaaaaaatcccaatattcccaatgtataatattgcaaaaaggcaagtttgtaaaatgtaaagatcatttaggaacttttacatgagtttaagcaatcatgactacttttataataataatcacaacttcatattgtgctgtgtggaaaaaaagtagttaccacagataaaacacttaagttgtctctgacacacagccagtgatccaaaaatattgttgatattatgattattttagtcattatttttaatactttaaattagctaacatgtgccagccatttaagatatcagtcttcatttaatagtgattgattttccaacacatcaagattatattctctagcaaagtcctagagaacagatactctgtgtacttgtttaaatgtaaatgtttaagtttgggcagtcagttgaacaagctggaaagctaaagttgtattgtaaaggtggaggctcttcattaatattctagcttaaaaggtaattctgtgtactcttatcttattctcaaaaaaaaattcctcactcacattaaaagaaagtgatagtgccagtagcagggggaagagagtagcagaataaggacaagggataaatgactagtagtacaatagtgattattactgatactagcatgatctcggctcactgaaacctccaccccccaggttcaagcgatctgattctcctgcctcagcctcccgagtagctgggattacaggcacctgccaacacatctgactaatctttgtgtttttagtagagacagagtttcaccatgttggccaggctggtcttgaactcctgacctcaggtgatccacatgcctcagcctcccaaagtgctgggattacaagtgtgagcctccgttgttgttaacttgcagaaggtagacttgaatccaagtaaataattgtgaaactgattctctaattcttttgtacacaaaataattgttgcgacaaatttgcttgcttttccattatgtattagattctcagataatgtttgtatatttcaaaagaataagactcttgccaaaaagtatcaagtgtttgaaaaatgcatataggcattgcctttataatatactcacatgaaactgtacagagaataaatcatgatggtaagattcaatatcggtagcaaatactcattaaaaaaactctggaaataattcaaatatcttacattaagaaatggttaaaaacttacataatgtgcataccaagccattacaatccttttttcaaaacaatgtttaattacactgtcagccgtggtacaggtatagttggaaactaaggaacaaaatgatgagtagaacaagatcacagtttttttgtagaataaaaaggcatatacaatgagaataaaattttctaaataaacatcacatatgtacattgagttatataaatagaattaaacccataatgaaatggtacacattttaaattgagatagagatatgggtaaatgattttctttttctaaattttcatacttttataaaactacttacattgatcttctattaccattactttcataaagacatcacagaatgagatcagtgctgatctgtctataaatagatgttttattacttcaatactgggtgggtgaagcagacttttggcagtgaatgagacaaaacattgaactcaagttacattaaatgtggctacaggcaactgcaattacactgagttcctggatgcctcatgaattatctctaatagccatacactgaatctccaattaaaactgatgtcaggccaggcacagtggctcatgcctgtaatcccagcacatcgggaggctgaggcgggtggatcacaaggtcaggaggtcaagaccactctggccaagatggtgaaacctgtctctactaaaaacagaaaaattagccaggcgtggtggcaggtgcctgtaatcccagctactcaggagactgaggcaggagaattgcttgaacctgggagtcagaggttgcaatgagccaagattgcatcattgcactccagcctgggtgacagagaaagactccatctggaaaaaaaaaaaagatgtcataaagttaaattatattttttaaaaatacttaccaatatatggtctgaattgacatattttagaatttctttttttatttgtaaacagttttataaagaaatttcccccaatgattaggaccagaaagtatatttgttatgacagaaggggttggtcattattttactgagaaaaagagaatttagaacaaaagggacaacagcaacaaaaagatgagtatacaattttgatatgatatccaggaaacttatgggtctacatttcttttcctctttctctctctcttttttttttttttggtgtgagaatacattgagcgatgtggcattagagaatggatttaagtttaaaaacagggacacatcaggaaacacaagtcagaataattctcattcatttcaaagcaaacacatattcaccaggagcttcatatagtgtgagggagctactctagggggtgagcagatctccactggagaaagtcctggtgacctctcccactgtggttcaagtgccccctgtgagacacagcaaagtgatgatgagggtcccccacattcagttatacatagcacatcaaattcacagtgtgatttcaggacaaaaggtgtcatagtcatacctaagcaatgacctgagaaataagatcacttaattatgtaactatatagtatataatactgtattataaatggaattctcagaactatttcccagaaattccaaaccacaataccagactgctgaatgtcagtgattcttatacttcagcttttaaggtgtttttggggggtgggggtgtcgggggcagtgaggggtagtggggtaagactaggaaaccctaactttaagtgaaatataaagggttagagagctagaagctaaataaatgtagatataatatcattccaattgtaactaacttttcctcattgctcatagtcatgtaatggctccaatgactcctaactaaaagaactgaacagaaaaaaataaaataaaataaaactaccccaaataaacacaagagatttagtagaaccacaaaaaaaattagaattgaagccaagtaaagctaccttccaataacctatgttagtaattataatattataaataaagtgtctgggtgtaacattttctagcattatctcctcctactgcagtgtcatagctttgtttcatttcctccttacacacacatacatacatgcatatgcacacatatttacacaaatttgcatgaaagatcccacatatattatattacacatctcctttcaaagaaactgaatgattaggtcagtttaaaaaaattactccaatagctcctgactttctcatcttagatgtttgtaacaatcctgtcaatagtgttttctgtgctgttgctcttttctgatagaacaaattctttcttcacaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttagataaagtgccttaactgtggatggctactaaatgaatctgttaaactcttcaagagtccattacagaaatgttctgcctgaaaatttaactgctatgatagttctaattatctcagacatctgttcaaagcaaaaacatatatggaagatcttaaaatcataaagagaggagttttggttgataataacgttggcattaatattgtgatcagaaggaaatatatttaagaggtgctagtgaagtttggtattatcatggtatcgtagcatgtacatagaaatcactaaattctgccctgtcatttgctccttttggtttacaggattttagaaggtactgtatacactgtagatattatcaaaaagcagttaaattttaataagttactgtactatcacaataacaataagcaggtatcgaaaaaactttgaaatgcatcatgcagcttcgtcttaccaagcaatctggctgtttttacttcccatgcattggaataggtctatttagcgttctgttcagggtgccattcagagaaagaatgtcctagtctgactagccactgctctggaggtacccacctagccaagtagatttagagaaaaaaaaaaaaaacttgtctgctctgctgacttgggtgccactaatgtcttaagcagaaaaatgtaatggaaaggatggagatagaatcctgcttttagggtagactatgtgcattattaaatgtggcccaacaaagactatgctctaagaatcagattagtgccttctccagattgaggaaggagcagaaaatataaataaacatggtaggaacttattttctaatctatacaatctttgtgtattttcaatttacgttttagtttcttatctgacatagccctctctgaatgatctatgcaagtttttgctgaaaacacagagttactttaacactcccatatcaaatacaaggtcaacacttgtaaattctactccagtttataaagattgcttgggaattctaaaatcagtaccttagtttggtactagacatggtaatgactggctatagctgaccatatatcaaggctgtcaatgctaggtagtgcatcatctaagtgtgaaagatcagttaagcaaaatgcagcaaaatacaattttctacattttcagcatctgtattgttaatcatgaattgtcaatgggctcctttttcctacattgttagcatttacaaaagtagcaatactgataatagtctgaatttgtgtcaaacactgccacttgaaatttttcctgaaagtagcacttgatagttagcaaatgaaaagaaattacacatactacatatgtagcattatttctcaccatatgtgcagtttaaatatttagtcttttgtaatcaatgatgtcaaattcataaaataacttatgactagtagacaagtggatataagtaaactcttctcatatcactcaaaaattaataaatttatattaaatttggaaggttacagctagtataaagtatataaaataaatatataggttattactaatttgctacttttttattactagaattaagactgcctaacaattcttaaatatttgaatatttcattgataatcttgtgaaccccaaatatctgatacaggtctcagtacatttagaaagtttatttttgccaacttgaagcagggaggaggcattcctttgactttctgattagcctctccaaggaggcaatcagatatgcatttatcccagtgagcagaggggtgactttgaatagaatgggaggcagtgatttgcttagtgactttggggcccccaggcttattttccttttacatttaaaaaaaatcttttggagaaagcattttagaagaaaatgagtctctggtctcaggttttcatctgatctctaatggcaaggaaggtttattcctaagcaggtcctgagttattaggaaagttcatttttagtaggttgtgaagtctcatgtcctatgaagacaaaataaagggagaaagggagaaaaacaaaaccaaacaaaagaaaaatccttgaaaattaatataggcccattactctgaagtccataaatcagtaggcaggtatgaaagtggattatgtatgtaaattggctgctgttattttcttctggagtttaagttgtctagcttaatttgtagggctttatgaaagcatgacttagtttacagtgactccaaactaggaaaaatggtggaaagggaggaaaaaaaacctgaagacactattttgaagacgtgtcgccatgaaaaattagaattcagtccaaactgtagacagtaataaaagttgaaaaacattaggcaagactagaatctaacaacaggtatactgttatttttgaaacataatttttctgtcttcagtttcccaattttactaaagataaaccatggtacaactgatttgctttattatacttggcctgattattgtatacagaggaggaagaataattttttatttacataggcttttaaagtggctttgatggaactttgtcttatagaaagaatctcagataggacttttttaaagctgaggaaagccatagatttctaccatcaaatacctacgagttgggtgaattcctctcctcttggggttccaaaataaacttggggttcctgggcctgtcagaaagttacattctttgcttaacacagttcaggaaccctgtacagggaccttatagatgaaggtatgaggccagttttcccaaggggttttattggctccataagttaagtttgattccctaaaggaaagcccaccataccagtggaagccttgataaaataaccagtttctccaattgtgttttgttaaaaatgaaaatagattcttattgcacttatgcaaataactgtattgacaaaagtaaaaaatactcacaaatagtttccaaattctgaaaaatcaggtagagggaaacaaatatgttctaaatttttttcataggagtatactaaattgttaaaagctgttaatagctcaaaaaaaaaaagattccttcactctgaaaaaaaaacaaaacaaaggatcagcaatgttttaagcaaagtctaaaagattactttagttttttattatttcagtccatgtagttaattcctgttctgcttgatactcatgaacattttagttctccatgagtcctgaaagtttttcttccattctaatgtcacaatctccaaaattatcaaaaactttttttcaagagcacctgttagaattttatggctgagtataaaatcgccttctaaagaggaccaaagtaagacaacaattgtctgtggaggacaaaaagttttagggcagactcagtcaaagacacaatggacaaggaaatttgttacctctgtggcacacaataacttaacacatataattgttactgataacgtacacactaagtcatatcagaattataggagtttcccataattttggaacacataacaataacatacttatataaatacagctcaaaaagaccaaacaccatttcatatttgacaatgtttcctgtataatttttatacaaaataaaccaaattatgtcatttttggatgttagggaaactaataaattaaaggattacttaggtcagaaaaaatcataatttataatttgtttggaaaatttctcaaatatcaaaggtttaaaacacttaatatcacaggtaagataaatcattcatttgactaatgtggtaactcaaggatttcaaaaaaaggcaaaaatcatcattctttgagagaggagactcaatttgccaaacaataagccctaataaaatagcatgaagccaaataactttgtttttcaaaattttatgaacaatctataaaattctaatcttgaccataagatataactttcctcagcctttcataacctttataatctttattaagaagtcagtttatgcttccagaaaaccttgttaatctgacacaggggcccatatgttggtcttgcattagtgtgtctttgacattaatgattaatttgtaaataaactaacttatctctcagtatcagttcttaaaatctcacacacccacctcttctgtgatagtccctggaccttgaggagctgaatagcttttagaaagcactgttagcattatgccacaacaaacagaacttgaggaaaaaaacttatatgagttgaaaatgagttgaaggatagtgttgccatttcacaccctttatggtttagctttgaaataaaaatgataacagttttttcccaaaacaaaccttactgcctgtggactagattgcttaaggccacagggttagaagttatgataatcttacttaattcaagatgtggctattttcattaaaccaatatcaatgtcttatttattaaaaaattacacaagcaaagatcattctgttttgggcttggtttacagttttgtaacccttatgtcaaattttgacaccttaaagtatttggcaacaataagtatgaaattgcttgattaataaatgcaaacaaaaatatatgctggaaattcttaagacatttctaatattatcatactttagcaataattgtaaagttatcttatttataaaagattttattgaagttacataaacttgaaaaagcatttgactagtcttttttttctggcaaagtatttaattcaagcacttttattttcttaagccaattaattagagctcttttatatattttcagtaataaaacattgtgtacaaaacacataaatacatacacacattaagcatgccaatagaagtacatcttatagatttatgaaaactacattttgccatattagacttccaaattcttgataacctgtttcaataggtaatctgtatgaatacttgatcaccataggcagttgtaagctaaatagtcttacatttgcatattaaaagaaaccaagtgaaaattaaatagcaaaatttacatcataaggtacagagacaaaaaatttggtgtgctggaaggaaaataaaatggattcaattgcctattaaacataaaattatagaaattataatggccttttaaatatatgcaaacacatgtacacacacacaaaagattctatggcttttacttcagaactttagccatgagataaaaaaaattgaccagcttgcagacaaaaacctgttgaatccatagtgtggtttttatcttaatagaaaaataaaagcaaatttaaagcaagaagaaaagaattttttttaaaaagagagaacttaggaactctatagcttgcaggacaacctagggttcttaatgtatatgtgcacaaagaccgtattaccttcattttacataaactctgccaagtagaggtgtcataaaacctaccaagtgatatcagggggtcattcttcttgttttctcatcattcttagattatttgtttcccactttttttcctaaaaggaggaactgagctgtggcctagggtttatgtgtggtgaatcaatgtgtgctgcttgtgggcagtactccacagtgtgtcaccactgagttgtttccaccctcttacatgtctcagtttctctctccagaggtgtatgacctctgagagggctcaaaatgctgggtgatctgccctcatatgtgtttcctggactagcctttttttaaaagttaatttttcttggggatttccctgcagggccactccatgtcacagggggtcaaccccaagacactcccacaaggcccccagttgcttaggggtgccttttgcctgggaggagcagatgccctttcactttggagctgagaaaactcagtctctcattttcctatgtaaaccacagttcagtttctcacacaaatccacacagacaagccaaatgagattaatttggggaataaaaacaatagaggagaccctttacaacacatctccaaactagaattaggattcttaaacaacaacttcctaggaggaaaaaaatagcaacagtcaatactacttccagtaaactgtactcagccaccccctactttgtaactcgtctgccattacacatgccaaggtaaaatcctctcacagtacaaggtaatctgtggtaatctcaaagccaaagagatcaggtcattcaacataggaaaacagagctttggactgagaaaaaaatctgcccacaactcttggaactccacaaagaaaacagacacccctaaaggggtgagtggtgcctttgttctgaattctttaaaagagttcaagtcattagaagccttctctagatttttcatactgcaaatggcaaaaggcaaaaggaggtatagggtggaggaaaagtaaacaaaagaacatttgtttttttaaagacaggaagcaaacacagaaaccaagagcatggtttttaggttttgttttgttttgttttgttttctcttttgcgtctgcaaagaattttagccaaattagacaggctttgttacccacaatttggaattctcactcagatttgatcaagtcaggtaaagttcatcaaatctgatgggagaaatactggaatgtacaaaaaaaaaaaaaatcccagaaatgtgatcactaagcactgtaatggtaaggagaaattaagtccagctagttgttaaacattaaccaagacaaaaccgcaattcagctgtttacctacggatgggtttcaggccaaaactgccctctgccatcctagaatcaggaaagaaacctcaaattcatcctccctcctgggagcgagctcaaactccatagagttacctgccttccattgtcatggaaacaggaaatcttgcctttcttgtaggaagcaagtaaaactccaaaaaaaaaaaaaacaaaaaggagttgtacagcaaaataaacttcagatcttgtctgaattttggggtatcagagattctctggaggggttgctcccagacctcagccaattgtcttctttgtttgagccataaatttagctcatgctggtaccaagcactgataggacatttatcaaaggtcagggaacctccactcagaatctcttcatggttaccaaaatatgaaccctgaatatatgagacagttctcagataatttagaaagtttattttgccaaggttgaaaatgtgcacccatgacacagcctcaggaggtcctgatgacatgtgtccaaggtggtggggggacagtttggttttatacattttagggatacatgagacatcaatcaacatatataagatgaacatttgttcggtccagaaatgggggacagctagaaacaaaggcagagcaacttgaagcatggaaggggcttccaggtcataggtagatgagagacaaatagctgaattcctttgagtttctgattagcctctcgaaatgaggcaatttgatattcatttatctcagtgagtcaagggctgactttgaatagaatgggaggtaggtttgccctaagcagcttaacttttccctttagcatagagtttgggttgccaagatttattttcctttcacaatctcatgtgtctagctattatgttagaaatgtcattatttctttatatacaaaattgattataaaagtaacgacattaaacgtgggtattcaacttacctcaaacttttagtagttctcattacttgacatcacttcttcttatttcttcatcttttatatggattaactaactgattattaatctcttcagaattctaacatgctatgtttttagagttctattcattgaacaagatattttccttgccctaacaggttctatggagatttgatggcaagaagccaaatactttaggttccaatactcgactgtacaagtggttaccccagaatgaccttcttggtaagattctggagaacaaacagtgaatatattagtaacagcaaattggagtgataatagttcaacataaaacaaacatatttagcatttattattggaaaactaaaaaacaaatcaaatttaactactttatatttattttccagtcttagtataaaaagaatgcactatagtagttggcattttattacatacagtcacattctttatggtcagaataaaaatctctttgttcaggtgtaatttcctctcacaggttttaaataacatcctggattttctgtctgtctcctatttatgcagctttacctctgttctttcccctactgcagggttatttcaacaggcactgaaaaatagcggacacttttctattaccagtgactctactttttatgggaataaataaccaatctttatcatgataaaatgataacacatttcatgatgatgcataaccggtccttcctcagccccacctccaccctactccctgctgccttttaaaaaaaattaaatattttaaatattttaagtatttaaatattttttaaatatgtaaatgtgacctcattatttataatacttaaaagaccacgttcttgtatacccaatcttattcttttttttgcacattttaattttttaattaagaatatgctttttcattttgttcacctggcaattcttctgaaatttgaaaacaatttcaatgcagttttgtgggtataatgttacctagggaacagttttgctttaagttccttatattgtgcatttcttattcaattctcataccttgtaattaataattttgttaaaatgcatccacttttaggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtgtgagtattacagttttgtgaccaggtggtatttataaattattttgtcaacagtgaatatgaattttaacccgtttttaagagactaattttgaagggattgaagtgatttaaccaatgtaaaatctgtccttactttccaccagacagtttatttcaaagttacatttcaaccccacagatttaatgggtcaccaatgactgcaatgaattataaaatcaaaaaaattaaagatatgtagataattattttaaatatttttaatgatagaatgcacaatgaaaagaaagaacataactagagaaatatgatatttcaattcaatacctaaaatttctgaaagtatgaatctattctttctcaaaaatttatttttattatcattattttaagaaatgtgataatgaattataatttgcatagcataacattcactaaaatttaaaatctaaatatatttagtatgtttacatagttacaaagccacagccctaaagaacattttaatgaattcaaattaaactcataatgtatgaagtcactcccaataaacctctagtcctagaaaaataccatcttactttgtttctcaatagattattctcttcacatattttatataaatgaaatcatacaatttatggtgtttcataaatgacttctttcacttagcataattagttttagttttatttatgttgtaggatgtatcagaactcattcatttttatttctatataatattctttgatatgtttataccaaaattacccatttatcaggtcatggacattttaggtctttccaattttggcatttatgaacattgttatacatattttccgtgtaaaaatatgtttttacttcttttgaggagatgctaggagtggacttgctgagacatatgggaaattgttgtttatgaagaactgctaaactgtttttcaaagtatttgcatcatttttcattaccaccagctggataggagggctctaatttcttcacactcttcccaacacttgttatcacctgtctttctattacagccattctagtgtgtgtaaagtggtctctcattatggttttcatttgcatttccttatggctgaagatgttaaccctcttttcatgtgcttactggtcattcacacatcttccttagataaatttctattttaatcttgtgaatattttgtctttttctatttatcttatggattcataagaattatttatatattatagatacaatcccttatcaaatatgtgattttcaaatattttcttccactatggacagatagatttttttttttactttttggaagatgccttttgaaatacaaaggtttcaatgttgataaaataaatatgtaatacttaacttttccataatccaaaggaaatactatgaaaaatgctgtgcctagaccagctaccatcaattcagagtctattactcctaccaatattattatgaggttaggtggtaccagctaagggaatacattaaaaacactttaccaaaaaattagtaagacaagaaatgatttaagatacttcaaaaaaagtaagaaagtaaagaaacataaaacaggttagaaaattaaaatatatatatatatagaataagatgctggatttaaatgtgaactagagaaagaaataaagggtattcaaataggaagggaagaagttaaattgtctctgtttgcagatgacataattctatagttagaaaacccctttgtcgcagctccaaaattccttaagctgataagcaacttcagcaaagcctctggatacaaaaatcaatatgcaaaaatcacaagcattactatacactgacagtacatgatttgacagagagccaaatcatgaataaattcccattcacaattgcaacaaagagaataaaatacctaggcatatgcctaacaagggatgtgaaggacctcttcagggaggactagaaaccactgctgaaggaattaagaca

SEQ ID NO: 14478 - DNA, 20599 bp, Human; identical to SEQ ID NO: 14477

SEQ ID NO: 14479 - DNA, 39085 bp, Human
tggaactaaaaaaatatataaataacatatatatatatttgggatcttaaacctgcatattaagatctactggtagatgttagttttatctgaaagtttccacataaattgtgagcaccaatgcccatctcaaccatttggttgccctcctcaaccagtttggttgatccaatgccagcgcccagctcccactgcaggcatcaccacacgaccctgatctggcagacgctgtgcacagggacgtctacgggggtgggaggatgggttccagggaaactgttctttcttaataaaaaggaactgatgtggttggagctgcccttgctcccctctttgcatcttcaacgtgggccagatgttcagaactgcagtgacattttgtgcccccaggatgccaagcaaggggcacaatccagccaaccaaggatgacagagacgagacagagaggggtcccagtggaaccaagaacagctgaatgaacaccagccaccacctcctagtgcactcctggtctatgaggaaataaacccccacgtgtaaattgctctagttgttctatttcttgcagctgaacacattctaatcgacataactgtcaggggaaaagaccttcagagaaatgtgcatgttgtactgttttgtgaaatgagattatgtatgattgcacaatagttgtgagcacattgaaagactggaagggcggctgggcgtgatggctcacgcctgtaatcccagcactttgggaggccgaggcgggcggatcacgaggtcaggaaatcgagaccatcctggctaacacggtgaaaccccgtctctactaaaaatacaaaaaattagccaagcgtcgtggcaggcgcctgtagtcccagctactcgggaggctgaggcaggagaatagcgtgaacctggaaggcggagcttgcagtgagccgagatcacgccactgcactccagcctgggcgacagagtgagactccatctcaaaaaaaaaaaaaaaaaaaaaaaaaaactggaagggcaataataggtaacaaagtactgagcacctactatactaggtacatctcattgcagccactctataagatggatgcttcacggttatgctcatttaagagtgagacaactgaggttccaaggggtttaataactttctcaaatcatgcaaccaacagatagctagcttgggactcacagccaggtctggctggccctagagaaagtgcttccaccaccatatgcaccccaccagtgcctactggctgcacagaccgccaccagccctagcagcagtgatttctggagagtgggatgggagaatgggctggtggtgaggaggtttgtctttatccacttctttagtgtttcctttttaacaagcaatttttgttacaaaagtggacatccagagatattgacaaaataacactggtgccaggaactgtgctaggaatataatagttttcttccggatctggatctctactgtggatatccactggtcatacatgcctactggaaataaaaagcattctttcctaacttattccaaaccctggctaaaggaattctggggttgccattatgttactatgtgacctacgtcccagataaggaacctgcgaatctgccacctccgccctcgggagagccaggccctgcagtcactatatgtgaagaatcctttggagcctggaataagagggttttatgcatcattttttaatcaactggatttctcacctcccacctgtgcctaaatggtggcttcttggtatcttgaaagggggtgctcagcaggagaaagcagctccatgtttctgggcagcccgtcctatttacagactgctgcggctccctggcagctgccacagtccccgaggccagagggagttccttgagggccccagcagttgtttgagtcatgtgttttgggcccttttccttagagatcctggcagggccagcacagatttcttatcggcttccacactgcggagctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtgagtcctggggagcaggcatggggcacagagcaccccaggcccaggcaggggtgtgggagctgcaggtgctttggcaagaaactgggtccaaagcttattggccctgtgtgccctagatggaagctgcatttcaagttcctatcatgtgtgctttgataaaggggcctttgacttgttttgagaaaggaacgaaaacatgctatgaagaaatacacatataatttttccagttattataatgataccaagtgcagtggcttgttgcattaaaatatgtattgtgttatcatgacttgtacttgcacagagagagtctcactggaacaaagaagtagaggggtgacgtgaaatatctctttatgccttttgcagacatgagtgttttattgtaataagctttgcaaatatgttaggagctggaaattatgtacgacataggaagcttggtagagccccttcctgcatctgctctctcatcatctaaaggagtgttttgctggctacgtgttttatttcttctctgtgactctttctttatcttcacctccacttggtgtgcaggaagccaggaggtgctagtcctgggaggggagcgcagaggtttcttccacagggttctctttggtgctttatcccagcacagatgaggccaggttcacattacactgctgatggtcacagcccagtgtccagtttaagtctgtaataaaaagaatccggtggccaggcacggtggctcctgtctgtaatcctggcactttgggaggccaaggtgggtggatcatgaggtcaagagatcaagaccatcctggccaacatgttgaaaccctgtctctactaaaaatacaaaaattagttgggtgtggtggcgggcgcctgtagtcccggctactcgggaggctgaggcaggagaatcgcttgaacctgggagatggaggttgcggtgagtcgagatcgtaccactgcactccagcctgggtgacaggacgagattccatctcaaaacatacaaacaaacaaacaaaaccccagctttctttgggcttcccttgtagtaattccaggggaggtcctctcaggagctgaaggaacacatattttggggatgaaagagactcaaaatgaggagctaacaaagtccaatcatttaaaatatttactctgagcaattaagtgcttttaacacaaaaagtgatagcattagattacaagatgtaattatcatttgatcaccacagactgtatttatttaggggtggtgacccagtagcaggacccaggttaacggtgcattatccttgcttttttcctgtgggtggatgcttcagctctgtttttacctcatttggcaataacagccacgctctgcatttaatcgccttccagaatgtgagggcaggcggtgccctgttctgctcctgtgggtgacagccctgctgagtgacggtagacagggactttgcctctccctgtgcggaccctgctatcctcaatgcggttgcctgagtccatctcagggtgattcatccacataaattgggctccccctctgtgcagggctcttggctaggcagtggctgccatggtaggggtcttgcttatctgctgcaaaactctgactttatggcggttgagcaaggagacaaagtggccctaggaactggataattgaggtgcttattaatttggcatttcctaccgtgtgataatgggcgtgatttactcttgctaggaccttagattccctttgtgaaatggagagtatagtagcatccctaactcttagggttgttgcagagttagcgagcgcatgtgatgacgatttcaactgtgccggccccgtaagacacgcacagtgcctgtcactaccgcggttccaagcccagaccagatttgcctgtgcctgagccgtcaatgaccactggcggcatttgaggagcctttcagccccccactgcactgtgggagccactttctgggctggccaaggctggagcccactccctcagctttcagggaggtgtggagggagaggtgcgagcgggaactggggctgcgtgcggcgcttgcgggccagctggagttccgggtgggcgtgggcttggcgggcccgcactcggagcagccagccagccctgctggcccccggcaatgggggacttagcacccgggccagtggctgcggagggtgtactgagtcccccagcagtgctggcccactggcgctgcgctcgatttctcgctgggccttaggtgccttcccgcggggcagggctcgggacctgcagcccgccatgcctgagcctcccatccactccatggggctcctgtgcggcccgagcctccccgacgagcgccaccccccgctccacagcgctcagtcccatcgaccacccaagggctgaggaatgcgagcgcacggcgcaggactggcaggcagctccacctgcagccccggtgcgggatccactaggtgaagccagctgggctcctgagtctggtggggacgtggagagtctttatatctagctcagggattgtaaatacaccaatcagcaccctgtgtttagctcaaggtttgtgagtgcaccaatcgacactctgtatctagctgctctggtggggccttggagaacctgtgtgtggaaactctgtatctaactaatctgatggggacgtggagaacctttgtatgtagctcagggattgtaaacgcaccaatcagcgccctgacaaaacaggccactcggctctaccaatcagcaggatgtgggtgggccagataagagaataaaagcaggctgcctaaaccagcatcggcaacccgtttgggtctctttccacactgtggaggctttgttctttcgctcttgctgctgctcactctttgggtccacgctgcttttatgatctgtaacactcaccgcgaagatctgcagcttcacttctgagcccagtgagaccacgagcccactgggaggaacgaacaactccagatgcgccaccttaaaagctgtaacactcaccgcgagggtccgcggcttcattcttgaagtcagtgagaccaagaacctaccaattccggacacaccaccaccacccaggcaggggaccgcaagcccctggctccttttggggagatctttctagcaagggctccgtgaatgcaatttaaaagttatgagagtctccttttccccttctctttcctcttcttatggtgggaacaagagaggctggagtgcccgcctggagcctctccttggctttctcatggccgtgggggatcattcctttagagactgttagttagctttagtgtcagtcagaacactgcaagatactgtcctacgggctagagagcccctttcacccatcatctcaggtgaagctattgccgggaactcacatctcctggtgagtttccattctttctaggaggaggggtgctgcccagtgcctggagagagggtgcagggggtcggctgaggggtggggttaggcggatgagggggcatttgcaaagcgcaggacagaggctgtttctcagctctgcccaccgcaggcctgggcctgctgttcattctccagtggcaagcgcgttcagattccatatcgaaccaaggcctgtgtttgtggtcccctgaaactcagatgcagtcagcctagttttgttgctgctgttgcttgcttgcttttgtcttgaccaggaggcacagtctttggggtgaggctgctaggagtgttttccaagacagctgactgctcacgtcatggttcctcagacaccaaatgatgtgctgtgggtgggggttggtgttggggggtgaggtgggggtgctgttcagggaagagggtgggaaatgagtttgcccccagcttaaggtagatcagtggttctcaaccctggctacctgttagaaccacctgagatttccttcaacaaataaatagcattcacatcagtaggcaaaggaaattcctttcttgccatcctttcctcataactcagtgagcagacatggagcatgggctgtgtgtctgggcactgcagaaacagacagaaggatggatcctgccctctgcaagcaggtcatgcagcaggaagccagtccgtgagtgtggtgaacactgaggagggatgatggggtgtttctggtgtgtggggcccacttgagaggaccagggaggcgtcccagagaggaaaaggaggaatagcaggaagaaagccgggcagagagcactgctgtggtgggaacaccattagtgaaggcgagaaggaccagagccgcttgctgggtgctggcccagggacatctgcggctgttggaacgtgagagggtggcggggtggctgagccttgctgtagtggtgcagggtggacacatgaaggatacggcttccctcagaatggaaaaaaaaatcctgccattgtggaagctcacagacaataaacaggacctagatggtggtcagggcagaggagaaaatgcatcgagtaagatgttggggaccagggaatgctgctccaaacagacggccagagaaggcactactgagagatgatccttgagccaaagcttgactggggtggccgtcacatggctcttgaggaagagtgtcccaggtggggcagcaaggccactgggcagtcagtcacaaggcaggtgtgtgccttggaggtttcagaggctggggctgaccctgtgaggatgagagagacgggcagccatgccaacccgggcgcagagattccacggtggtgcctgacacccacttgcggggacttggattttgcctctgggtaagactgggggcactttaggaggacccctcctgctggtgtgttgagaaccccctgaaggggcgagggtggaagtggggagacctttgcatatgaatgctctaaaacccaaagcctctagatagaattattttgagggtctccctccatcgctcaggctgcagtgcagtggcgtgatcacagctcactgcaacctccacctccccaggcttagatgatcctttcatctcagcctccaaagtagctgggactacaggtgtgtgccaccacatccagctaatttttgtatttttttgtaaagacagggtctcactgtgttgcccagactggtcttgaactcctgggctcaagcgacctacacgcctcggcctcccacagtgctgggattacaggcacgaggccctggccctgactggcatagaattctcgtagtagcactctcttatactgcttgggatggcagtgaagaaaaaaatgaaataagtctgcccccacatttccttctcagttcaagtaacaccaagctaccacagggcaattttaattcattccagcagggcactgtgtgaggacaatccacaaagacttgaaattccagggcttggccgggcatggtggctcatgcctgtaatcccagcactttgggaggctgaggcgggtggatcaccaggtcaggagatcaagaccatcctggctaacatggtgaaaccccgtctctactaaaaatacagaaaaaaattagccgggcgtggtggcgggcgcctgtagtcccagctactccggaggctgaggcaggagaacggcgtgagcccaggaggcggagcttgcagtgagcagagttcgtgccactgcactccagcctgggcgacagagcaagactccgtttcaaaaaaaaaaggaaaaaagaaaaaacaaattccaggagctggaggccacagtcctttacttttggagtcctcagttatggcaatgggtctgatttgatgagtccccccatctgctccatctccccgtgctgagactgggtttgtgttttagtgagactgagtcctgggtcatctcattggaaggctaagaaaatatgacaacgactccaaggtgtaagggaggcaaggctgagaggtatcctgccaggcataatcgccttcttctgcacgtgtgacttggagactccagagacacagaacgagaggggactgcactgctggcgttttagggtcccaggctctttgctggagttaagaccccctagtgacttcctcattcagccttttgtcttctcaggtatggaatcgcaggaagcgttaacgtgacgggagatgaggtgaagaaactggatgtgctatccaattccctggtgatcaacatgctccaatcctcctatagtacctgcgtcctggtctcagaagagaataaggacgccatcatcaccgccaaggagaagcgggtgcgtcatggggctgcggtgcccgctcgccagtagatgatgatactgagccggaaataagctgccttacttttctttaattcccgggattctcctctatttcttaacatttgttttctggaaacaaaggattacatacttctctacttggaaatcttgtgctgtctagagaaagaagactccacagtaggacagtgattcattcaggaaattgttcagagtgatgcaggaaccgcctcagtgggcgcttgttcgtggctgttcacttaatcagtaacaagagccaaatttttgggggcttaaccttgtggagtccagggaagagctgtactgtacagcctctcaccgccccgccttctcattccacccccgcccccagccggcactttgcgaggggttacagtttcagcagagatttcttagtgcctgacaagctgttagactggtccagaaacaaaaccacaagcctcctgtgctcttacctcgtaggatggtgaagtcggtgaaggaaggcacggctggggagggtctgcattcactatgggttcacacacagcttattatacagagaggtttgccaatggccaaaagtttcaatcaatgttcagctgcaatatagtcaatagacaagaggccatttctttgtgattagctggaggaatggaaaagaatttaaagtaaagccaaatttatttaacctctgctctatgccaggtactgcaaaaggcacttttgccctcgtctcacataattttagctacatcacactattacttccaactttcagtttcagttgatatgactcttgtttctctctccagtctgatctaccattgtcttctcctattggcctaagccacatagccacataggtcttcatgtcagttcctttatttatttatttacttatttatttatttttttgagacggagtcttgctctactgcccggctggacaggctggagtgcaatggcgcaatctcagctcactgtaacctctgcctcccgggttcaagcaattctcccgcctcagcctcctgagtagctgggattacaggcatgcgccaccatgccccgctaatttttgtgtttttagtagagacggggtttcgccatgttggccaggctggtcttgaactctgacctcaggtgatccacccgcctcaggctcccaaagtgctgggattacaggcgtgagccaccatgcctggcccgtggcagctcttgaatactccaaacctgctgatctctctgtcgaaaattcttctttctaggatgggcgcggtggctcacgcctgcaatcccggtgctttgggaggctgaggtgggaggattgcttgagctcaggagtttgagaccagcctaggcaacataaagatacaaaagataaaaatttagctcggcatggtggtgtgcacctgtagtcccagctactcgggagtctgaggtgggagaattgcttgagctcaggagtttgagaccagcctaggcaacataaagatacaaaagataaaaatttagctcggcatggtggtgtgcacctgtagtcccagctacttgggagtctgaggtgggaggattgcttgagcccaggatctctaggctgcagcgagctctgaccacaccactgcacttcatcctgggcaacagagtgagactctgtcaaaacaaaacaaaaacaagaaaacaaacaattttgctttctaggtctctgtgtgtttcttcattccttaattctagtcaggtctgtcatcaaatgtgaccccccctcatggctctccagcccccagcctatgtgggttttcgttagggcacgtgccacagcctgcttgtatgtgtcctgacctgtgtgctctctgtctgttctcccactggaatgtcagtgccatgaaatccagccttgctgccgggatcgctgaccccccggaaacaaaccccagggccttgaacacttacttcccagcatatgctggaagctcaacatgtatctgctgaatgcatgcatgcatgaatgaatgggctaaattggattttttttttaaaaattggattattatagagatgttggggaatttccaagtttacaaattatctaacttttctactctggctgagcaaggaaaaaaaacagaaacaaagctcaaatgaagctaggccaatactcattggaaagtcagggaaaactaaatcaagtggagggagaaatgaccctcatttctcttgaagttgcattacccgtgtttaattggcctgggggttccggtcgccatcactaagggtctctcgtgaccttgcacacagggggctataaaaaggacctggggcttcccttggtggcttgagctgcctgtgacagcagagtgggtgggtgtgggggacgttggtctctcaagacacacccactttatcttctggtcttcgcatcagacaggtgagatggatacaaaacccagaggagtatttgtgtataaactggcaccctgccctccgtaagtcatggtgttttttgataaagatatgctgtggttctcaatctctttttgatgtggtgtactctgccacgcacagccctgacacagagcaattgtgctaatgggaagatgtgctgatcagttggtgctttcctctctgatttaggggaaatacgtggtctgctttgacccactggatggatcttccaatattgactgcctggcctccatcggaaccatctttgccatctatagaaaggtgagtagacaggctgacattttacacctccttcctgtggtggtctctggaaggttcctgggctgaaaaccgtgtgtttggagtcctaccctttgtcttcccactaacgagaaaagccactgtaggcaaaccaccaacttttctctgcctggggctcctcattagaagaactggattggcgattctttctctgcctactttctggcattcctgggagggtaacacagaaggacagctgagatcttgttttgaaagtctgggtgcaacacaaatgtcagacatggcattaggttccaggtggcattctgaatctctgacatcctctccccctcttgcctcatctctcctgtccccagccacagaaagttttctgctaacgctcattggattagattgaactaatctaacctggaaggtccacggtgatctccctatttgaaatctgaacccctgagtacacctgaaaagtctttgttgccatgtaatgctgggtattcacagatcctggggactggcatatcttttgggccattctgcctaccctgaaatcctagcaacagagagctgggtgggtttgtgacatccagcaggactagaaacttcacaattcagaaaacttgtccttcattctatataaagtgtacaacggcaataaaatccatagcaacctcgccagctgcggtggctcacgcctgtaatcccagaactttgggaggctgaggcgggcggatcacttgaggccttgaggctaggtggtcgagaccagtctgggaaacatggtgaaaccccgtctctactaaaaatacaaaaattagccagggtgatggtgcacgcctgtaattccagctactcaggaggctgaggcaagagaattgcttgaacccaggaagtgcaggttgcagtgagctgagatcatgccactgcactccagcctgggtgacagagcaagactctctcaaacaaacaatccatagcaaccaaagagaaaaataagcagagtgccagttacattgtatttgagagtcttctatgtattaggaagttgattaaaccgtgctcttacagagtcttgagatagggaatctatggcagaaatatgagtatttaaggcctgtatagtttgggttatattgtgagaataatctggtagatatctaattctcagccttaattcatgcacaagtgttgccttgggttgtagttaggatatctaaagccatatgatttaaagacattgtgggattaagacatagtagcagtttgcttttctgtgtcttgtggggctgagggtatgttttgggcattattcaggaagtatgtacagcacttagttttacttatacttcatggtccccactgtcaattatatttggggttcctgtggggcttgataacaggttggcaaaatatacatatttaacaggctgggcatggtggctcatgcctgtaatcccagcattttgggaggctgaggtgggtggatcacctgaggtcaggagtttgagaccagcctggccaacatggtgaaactccatctctactaaaaataccaaaaattagctgggcatagtggcgggcgcctataatccctgctactcaggaggctgagacaggagaattgcttgaacccgggggcagaggttgcagtgagctgagattgcaccattgcactccagcctgggcaacaagagtgaaactgtgtctcaaaaaaaaaaaaaaaaaaaaagggggctgggaagggtggctcatgcctgtaatcccagcaatttgggaggccgaggcgggcgaatcacgaggtcaggagatcgagaccatcctggctaacatggtgaaaccctgcctctactaaaaatacaaaaaaattagccgggcgtggtggtgggtgcctgtagtcccagctacttgggaggctgaggcaggagaatggcgtgaacccaggaggcagagcttgtagtgagccaagatcgcgccactgcactctagcctgggtgacagagcgagactccgtctcaaaaaaaaaaaaaaaaaattagccaagagtggtggcatgtgactgtggtcccagctactcggctgagacatgagaattgcttgaacctggaggtggaagttatagtgagttgagattgcactgctgcactccagcctgggcaacagagcaagactccctctcaaaacaaacaaactatacacacacacacacacacacacacacacgcacacacacacatatttaacagattataggaggagctatgaatatttatgaagatggtcctgacatatgtgtattgaataaatatgcatgtatgacccatgtttattttggggtggaatgtattccatttaggtcctgtatatcaaaagatctttctaggacataaaggcacacagtgtgtgctttctgtaaactggccagacctagcccatggttggtggtcttttatcaggagagctactgaaatttagtcttttgtctaattaaagctgtagtcttggctggtggaacaagagcctgggggtgagttagtcagctgatcttaaggccagcgcttgtttggctgctagagaaaaagaaaaacctatggcagttaggacatggtttcctcttcaaaataggagtgagtgactaacccttgcctggcgtggccttaggtcccgtttctaattgggtattttattgtgacaaacagcctattttgtcaatcttagggttttcagttgtgcctaattccaaaaagtgggggaaggtatagggaggcctgtctgatcccgcttcctgccatggcctgaacttgtttttcagtttatctggggatttccttcggccaagaggcaggtccattcagtctgttgagaggcttaggattttattttagtttatattctcccttttttgtcaaggtattccaggggcagtattgatggccaagcttttattttgtcccatgtggatgctggggtggtatggttaccttcccagggtccatgatgttcctcgatgggacccctatggcccagggacttagagtcaaaacagtggaagccagttaaatgttccaggccagatgggaatggaggtggccaggcattcattaaccttaaaaccccttttaagcaatgtaaaagccaaaaacccaaagccaaaaggcaagcttccaaaattgacttatctacaaatctatacatcgagctactgtgagcttggctagtagcacttagctgcacaaaacacaagccttttgttcagctgttgaagcctctctgtgtccgtcctggatttggaggctctgaattaatttgatcccataagactggcccttactatgtcagacgctcacttcttccactatagtctttaggcctgggggattgaatagtttcaattctggaggtaaaacaaaatacaaagaattagtaatgttttaaagtatcataagcccagcctagttctgagaatgacaggaaaggaggcttataggtagttaagcattttaattatttggtattaaggcatagaataaatcatattactttagacagaggcaaaattaataaattaatcttactggttttgactacaaggctgtccttgtgtctcattaaagcaggtgactttgattgtcacctttgcctggatccagagacaaggctttggttagcttgagtttggtatcagatactggcaggagccaatgccttctttagatgaaatatgtgcacccaggagtcaaagccctgtaacttaactgcacaaggatttgttaatagtacctgataagggccttttttagggactagaggtagtgatactagagactttgacctgtctggaacctgtaaaatgattttaaaacctagtggtgattaatttttatagctttggtaaaccccagcagaaagtcagaaacttaatttaggattcaattttgaaaaagttaaagatgttaaaaggctcaaaacaattgattaaaacagaactgtaggtcattgttaaacaatagttgctcatttaaccagagtgataattgaaagattgaaaaggcaatccaggctgggcatggtggctcacacctgtaatcccatcactttgggaggctgaggcaggtggatcacttgaggccaggagttcaagaccagcctggccaacatggctaaacactgtctctgctaaaaatacaaaaattagctgggcgtgttggaccagccacttgagaggctgaggcatgagaatcacttgaacctaggaggcggtgattgcagtgagctgagattgtgccactgtactgcagcctgagcaacagagcaagattctgtctcaaacaaacaaacaaataaaaggcaatacagaacgttatatggttgtacaaactttaacccttttagatctcaacttttctaagcaattaaaacctaataaagacaacataggaattattttgataaaatgtaaaatgttgtttcttaagtgaattaccagacagggaaagaaaaacctgcagtgtagctgcttctctttaggggaagcctatttggataacctggaagtcaaactgtgagtgtatcagggaaatagataattctcagtaactgcatgagaagctttctaatcatattgacaaatttagacatatcaaggaaagtacagaatcaagtaataatgtaggaaaacattgcttttctagacctttaagataaaatgttttagtgccaggccataataataaaattggaggaaaaagatcacaagagttgaggaaaaagctgaatgagagagttatcctctcaggccttctcaaggggagaaaaagctgaaagcagcaagacacagcaaagccaaacttctgagatatgattctgagaagtttttaagagaaagaggttataaaagtaaaatttcttgttattaggagcaaataaataccttaagacagacaaccttgctttaaacatagggggctattataaagaatccccttttaattataggtaacttaatcacatgcaaaattcttttataaattctccacaaactttaatacaatttatacaaaccatttatgacatgcttaaactttttgacttgtcctgaattttgtttctttagatatcagtcattatttttaggacaagaatttaccatacaacttttttttttttttttttttttttgagacagagtctcactctgtcgcccaggctggagtgcggtggcataatctcggctcactgcaagctccgcctactgggttcacaccattctcctgcctcagcctcctgagtagctgggactacaggcgcccggcaccatgcccggctaattttgtgtatttttagtagagacggggtttcaccgtgttagccaggatggtctccatctcctgacctcgttatctgcccgccttggcctcccaaaatgctgggattacaggcataagccaccgtgcctggccaagttttttttttaatatataaaattattctctcttttaaaataacctttttttttttttttttttttttttttttttttttgacagagtctctctctgttgcccaggctggagtgcagtggtgcaagctccgctcactgcaagctccgccttccgggttcacgccattctcctgcctcagcctcctgagtagctgggactacaggtgcccgccaccacacccagctaattttttgtatttttagtagagactgggtttcaccgtgttagccaggatggtctcgatctcctgaccttgtgatccgcctgcctcagccttccaaagtgctgggattacaggcctgagccaccacgtccagcctataaaattatttttacaatacgaatacaattcatagaattatatagtcattagaatttttatttctactaactttaaattttagtggaaacttagtaagcaagaagtcctgaacggtttgtcagatgttagcattttatagatgaagtcatttcacaattttagaaccatgttttcccatattttattgtaaattagtcccataatttattataatttttaaaaaattagaagtaaaccagacatccaataagcatttattatttaatttaaaataattttaagattttaaattacagaaaaaattcacttaaaaaacatatttcatttatgtgtatttaattttttaatctttaagtttatctagattctttctgaaaacagatattatacaaagttagtcattatttaaagttatttccctgttaaccattttaaaagtccgaacattaggtgaacacctaagtaagaacctcaaagttaaatccatggtcattttgccaatagctcagaggattcagttgctttcattgaactaacaatcctaacttagtcttatttgtcaaaaaaattacacaaagattactctgtgtttggctgggttataatcttacaatctttgcgccaaaccctgacactttaaacatttagcagagacaaatacaaaatttatttgcttagacacaaatgtatgctgatgattctgaaggcatttttgtttttattttactaataatttttgaagccagttttatttatcaaagattcatgcgaacttggaaagcatttgaacttaatttatgtgtactcacttacttataaagccaatttggtagcatgctagacacgacagaacataactataacatgtacattacataaacatatctaaacatgtatacatccatacacaaacaaaggtctaagagcttttatctgagaactctaatcatgagatagcatcacaaactcactgacctataaaagctggcttcaagttgtttttctgacaaaattggaagctgtccacgtggctaactttgtttgccctgataggtaatccaaggaaagctggcagccaaaatttggggtaaagcagtctctatggcagtttgggtttttttctttttaaatcttttcccctttttgctgttcagtttcaaatgagttttcaatgtttatattcaatttagaccataaataatgagtcttgtctcgcgccagcagtttaataacagcagatttaaagcaggcagaaaagagaggaaggtagagagctaaagaagattctacttaactccacagtgtaggttaaccatttgaactctgaatttttcttgttgtaatttgcccatcagtttaaaatgtgcacaaaaatgggccagaatatgtaaccagtcccagagaagatgacaaaatcagaggccatgatgttggaaactgtttttctccttcaaggctgaacccctggattggacaggaaatgagaaaaagaaaagaaagagatgtagaggacaaaggtcaagttttacaggaaggaagaggaaagagaaaggaaggaggggaggcttgtgagcctttcagccactgcaaggcttggggtcagtaccctcaccacccaggtgtatctcctgtcagggagagcctcagtgccccagacctacatggtgtgggatgaacccttcccacctttgcaagtcaccagtcaaggtgaaatgtttctagccagagggagctgtgggtgcttttggccaagaggaataaggctgtgggtgccccaagattatcaggaggatgacttggaagaagtggggggagggagggctgagtagagtcccaaatccctcacctcagtttccaatgcccccccaaccccagccctggaacagcctgaacccagcaaggccccaagggtgccacaaatacaaacaaatacaaatgcataaaatgctcaaatggtgtcactagtggccaagtctaaatagagcagagtcccagtgacatcccaaaagaggcagacggtggtcaaatgcactccgactaactcaccaagttccaaagtttcaaagttccaaaattccaaagtttgtcacttctctaaaagtcactttcagtgcaccagtgaaatattggaggtagcaggcactgcagcaggaagagaaagagaggatccccaagacaaaagcatctaggcagctgcaggagactccctagcattccagccaaggggtcaggtagccacaagcaactggagcctacaggcagccccacaggccctgtccaatagaaaccagaccatgggcttgggcccccagagcacactgtatgggccactaaaattgtaactgaatgcaggtccacatgctcactgcctgcagagtccagttaacaagagtgaggcctggtagatagaaagtgactttattaaccacaactagtaaaggggaagtggccagattcccatcaaagcaaccactttgactatttcgggggaagggaggggtttaaaagaggaaaacttgattaaggagggcatgcaagagaattgtgctgagtacagtatctctgggtcttgtttttatgattatctttggtgccagtccacctggacctcaggctgacatcatctcaacagtggccgagttgttaattagctgcatggaagtaatctctggaattttgcagctaggtctccatgcttggtctgtctgtctcaagattacctcctggaacttctaagaaggcacataatagatactagcatgcagttagctaaatgtgcagggagtatatatggtgagaaagggagctattttatagctaagagaaaagacttctgcagtttgcttcaaggttatatcttgaaacccaagagaagggaaaaatgttttaaaatatattatgaagttaagctgcccagttacgttaggaagatggaaattaaaaccacagtgagacaccattctcctcttccagagtggctaaatctaaaaagactaagcataccaagtgttggcaaagaaactggaattcttatacctcattggtgggactatcaaatagtataactactttggaaaacatttgataggacctactaatgctaaacagatatttacacactatggccaagcaatttcactcctgggacccacacagaagaaaggaattctgtgtctgcccaaagatggagaaattagtcatagtagccccaaaccagaaaaatccaaatgcatatcaacatgagaatggagaaataaattgtgatatagtcatacaacagaaaactacatagcaatgaaaaagaacaaactgctatgtataacaacataggtaaaattgcaaagaaataaacttgaaaatcataagccatacaaaagaacatatgcagtgtcatttcatttagatgatgttccaaaccagataaagttagatttggtgataaaggtgagaatagaggttacctttggcaggaggtgatagtgactggaagagactactaggcctggcttcactaggcttaaagtccactaggttgctggaaatgttatataaatggatctggatgttatgtaaaatattctgtaaatacacataagtgtatattatatatttgtaaaaatttatcaagatgtaccattaagatttgtatgctctgctatatgctttatacctcaacaaaaaggaaaaaagtccacatttcataatttctaccaccaaatacatggagctcttgcaattttcattaattttaccaaaaagtagtggtaggaagcaccacttatctgatgggctcagatatttattggtgtagaaaaaaataaaaagacgcactaaatcatttgcaaactactataaaatttactgagaaaggtgtcatggcaatgaagattgctgatataaactgggtttttgaaatctcaggaccgtgttagacaaatacaaaaactgaaccattcttttttttccatgcatagaaataaattacagatgagttgatgagtttggtagagaggtggggaataaaaccagaaagaaaagacaagaatatttgtgtcaccctgtcttgatgtaggagaaattcagtctaaacataaagacaagagaagaaaacatatggaatgtcatgaataattttaattttaaaactgcactgcaaaaacaggcaccataaataagaaggcaatgacaatcgaggaaaatatttgtaacatatacaagacattaatatcctttatatataaagagctattaaaataaacaagaagttgaatatcctgatagaaaaataagcaagacatgaaagagacaacttacaaaataaaaatggtcaaaataaacacataaaaggttttacctgactcataaaaaatagaagttaaaacaaaagagatgtcattttgtccacctgtcaaattgacaaagttgaaaagacaatgctatcttgtgtttaccaggctgaattaaaatgaactctcttattattagtggtaaaagtataaattgatgcactctttctggaagacaatttttcaatatgtatcaaaagatttttacccaattatttaattattgggaatttatcttgggaaaatgatcagagaattgtgtatttatgcagtagattgttaatctcaggttgccttgtttttcaaaaggataaaaagagaatattagaaacaactccacatgcatacatttgacaacttagatgaaacgaaccaatgtctcaaaaactacaatactctaactcacccaatataaaatagatactttgaatggctatctacagggctcaatactattaagaaactcatgcccaagaaaagaaatctccaggctcagatggtttactggaaaaacataacaaatattcacagattattcagtctcttccagaaaagataataggaaggaacacttcccaattcattttatgaaaccagtgttatcctgatacaaaaaccagacaaagattgttcaaaaaaataccacagaccaatattccttatcaataaatgcaaaaactcttaacaaaatattggcaaatagaattcaacaatacataaaataaattatacaccatggctgagtggggtttattctggtgatggaagactgatccagtattcagaatcagtcagtgtaatccaccatatcaacaggctaaagaagaaaaatcacacaatcgtatctattgatggagaaaaaacatttgaacaaattcaacactcattcattatttaaaaataaacttgctgaggtaggaggattgcttgaggccaggagtttgagaccagcctgggcaacatagcaagacccccatctcaaaaaagacattagctggagagcggggtggtagtgcatacccgtagtcccagctactcaagaagttgagatgggaggatgacttaagcccaggagttggaggctgcagtgagccatgaccaagccactgcactccaccctgggcaacagagcaagaccctgtctctgaaaaaacagaaagtcttagaaaacaagaaatagaggaggagcgtcccttaactctatcaagtacatctacagctagcattacatttaatggtgaaagactgaatgcttatactctaagatcagtaacaaagcaaggatgtcctcactcgccactgttacccaacatatgtaatcctgaaagttgtagccagcacaataaggcaaggaagatgatgaaacacatacagattggaaagcaggtaataacactgttcttgcagacgacatgatggtctatgtagaaaatcccaaggaacctacaaacagaaaaccaaaacacttctagaactagtgagtttagcaaggtcacaggatacaagatcaagatacaaaatcaactagatttctatatattagcaataaactaattcgtaattataattacattttaaaatatgtgctatttacaatcacacaaaaaatggaacagtataaatccaaaaaatgtgtataggattcttatgctgaaaatcactgcatgtatgcatgtatatatgtgtgtgtgtaaactcatgtgtgtgttgtgtgtgtgtgtgaattaaatgcaatatctgtggactggattgtgctaggtgatgggtaaacagacaggaacaagacggagttggtacttgccaccaagttgctcacagtctagctgggaagtcagacactaagcccgtgaatgaaaatgtgttgggagcttcagagaagcagctctgagtgctcatggcgtcaagcgctggaagaccagaccatgaggtcagaacatggaggcaagaacattcgggtttacaaagcttctacgtacatcacaacaatgctgtactccaattctaggtttctggaggagagactcacattgggccagtttgaatcactaatctatgaatctatccttgaccccatcaaataagtgtgcgtgtgtgtgtgtcgtgggagacggggtaactcaatacaaatgtagcagctaagagtccccattttggataagggggtgaggaagaatcattttgcaccggttggatgtaccaagggccacagaaggaccagaaggagcaccaacatttaaggaatcagaggaagaggtgctgccgggaagagaagcaagtgagaaggagcatccacagagtcagagagaaaggcagaatcagggcttcctgctgctgggcgagttgtgcagccgctccagctgcagtaggttgttaatcttaggtggttttgctctcagagttctccctctgagccatggaggtgatggtgctatctgccccaaagggctgttgagtgtgcagagtgagacactgcacgctcagctcagtgatctgagttgtgagtatcgtggcttgggaacatggcttatgatgaagaggggctatggttttagcatctgggagtgcttttcttgtcaggctacagagacatgcgtttggaaaacaggaaggaagaagtccaagaatggcctttgccatggctcagctagaactgttggcaacatggccactcgtttcctctggatggatttgcagcagcttaaaattcaaagaaccgcgcttccttcagtgattcgaggagatctgaagcccaggcccctggcaaagtgttctctccagagacaacaataacacatggcatttatccctctcttccacagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggtaggtacagaatatggcatcatctgtgcctggggactccatgggcctctgtgccttaatgccagttctctgcgataatgtcctggttattcctaatacttgttttggggaccaggggtcctgagagcctagtttggggagccaaaaccatcatcagaaaccatgaagggcctctgtcccagtgagggcactcggggggaggagtgtcctgcagagccagttgcatcaactcaggccctctccttaaggagctcattttccaaaaatgcactcaatctctttggcttatgagaatgccatgatttaagaatcacaatgctgcaaatttccagcagaagcatgggttcgttagagcagcaccatccagtagaatgctccatgaatttcacttttaaatgctggatggcttgcccatcaattgtgaaatgctttgccaagtatactgaggtcttgtgaaaactcagataatatccaccaaagaacacgtcaaaacctcttgttcacttagaccaaaaggttaagtatttaagtttttgatttacagctgtttattgagcatctactgtgtcccaaagcaccactccagacagcggagatggagcattgatcaaacacacatgacagcccttgtggagttcacgtgttagtgcacatgtgtggagagaggggtttgcaaaatttcaaaatgacatggagttaacttacaaaacagagtttacagtatggaaacccagaaacttttcaaatagaatcttttcacctgtatgcccattagaccaagacccattgctgtgtcagtttgctaatgccccaatttccctttatgttcaaagaagctggcaaaccctgagaaattctatggcttgcaaatattaccctcagacaataaaacaccctttctaaagttgttgtagaataacagctaagagttagataattcttcgtaagtggtaggaatgtaaagtacctgtcctatgaaatttacatctattaatgcatttaaatgtcacagtggccctatgagatatgtcctacaattattcccattttcagatggggaaagtgaggcgtagagagagtgagtaacttgcgcaaggtcaagctagtgactggtgtcaggagtcatgctccagcagtctgtgctttaattactctaccacactaaatttccaacacaactgctcttgagtacaagcaaaatatctccatgaacattctgagcagttctaaaggtgatgggagatgctttgactcagggacccaattcaaagattcccaggcacagacagagcctctgttttctgccctcagtcatgacagcagggcccagtctggacataggtgggcaccagagcttgtcaacatgacagaaggaagagatgaaccatagcatctttccggatctctatgtattagcctgaaacccctttggatcacatctccctactaaaaaggacatttgagcaaagacccagtgcacaaagcttagtgcctgtttgacatccagcggaggtagcttgtggcagttgtcacagatagaaatgccatggaaggcggccagtagcttatggaggcagcattccctggtgggtcaaactgagcctgtgaggtctgtgggattgcagggctggtgatttgattttgtcagaacacacatattgttcaggcacagagagaccacctcctgttaaccaactctccattgtgggtaaagctcaatgtcaaggcattcatttacaaatgggagctgttgtttcttgtgaccaggatctggtgtctgataatcggtaacagggtgtatgagagcccatattaaaaatcagccgttgttggtgaccacacaatcagaacaaaggaacacattttccaggttaataaaattgtggaaacaatattcccagggcctgagagtcccggccccagccccaggagtggatcaacgtaaggcgttttcacccgccctgatgcagaatgagcgcctctgttcaggtggtgagtgagtgccactgttcagatgacagttgtgcatctccatcctctttgctggaaagcaacagcaaaattgaccccggctcaattaagtgaaaggagttactgcattgatgggaaagctgaggaccctggctaggaacgggcaggactagaggaccaggaagcaggaagcacggcagtggtctcgcaacatggccggtctggcctggacaccaaccccagtgctgcgcctctcactcaggtttcaaatcctagggaggcgtatctcattttcaagctaaggtacatgcctgaccttggcctacaagaggcccagatatgagtcttcctagactggcatccaattcaaagcaagtcagggcacttttcagaagtagaaatcagcgctgggctgctccaaagcaacagacacccacagcaagttaaaggtcatgagtcaaagaccatcactcgtgcacctgtaataacccgaagttagaattaggaggcactgcagaggaaccatggggtgttgcataaggagggagttgagatgggcttataggacttggggttttgcttggtgattctaaagaggatttgaggaagagagggtcagtctggattggatattgtctggaagtgggtgcaattaatgactagttaccttaatcatttttatctaggaggcagagagattgaagtcactgatatagaagcagttgtcactcatgttaggcaggaaaggattgtttagttgtttttgttattgagtctccttggcactgacttgtttctgacagggacagtgtcacctcttgtagcaacacctctgctatgtggagtcattctgtggccttgcctctttatattccgggaatacctctgatgttccttgggaaccttctggcctagctgccaactgtgagctgtcattttggagtttttcactctcaaaatcttggacattcatcaaaatggatctggtttccaggctctggttttcctcctagtgacttagacagacatgagcatttaaggtggtatctgccacaagctgatcccatttttagtgactgctatcaccagaactagacataggggtatttgagagatgccctgcaggtactgaccacagtggctacacgggttgtggagagggactgggcacacttttattaatatgtctgaggattcctttagattttaccaactttttccttacgctgggtgaacacagtgtctgatgaaagcggcttcctcttttctccaggtaagagtgggataccagaaactgaatagtttctatgattgaatcactaacataaacaaaataactgtaccacacatttttttttttttttttgagatggagtcttgctctgtcatccaggctggagtgcagtggcgcgatctcggctcactgcaagctctgcctcccgggttcacaccattctcctgcctcagccccccgagtagctgggactacaggtgcccaccaccacgcctggccaattttttgtatatttagcaaagacggggtttcaccatgttagccaggatggtctcaatctcctgacctcgtgatccacccgcctcggcctcccaaagtgctgggattacatgcgtaagccactgcgcccagcctgtaccacaaattaatggttaaaatgcatccctcatacgacaatgtaacttcttcctctcactgttgatggcctatcttcctgaaaacattaatctgggggtgagaacttgggagatacacacagttgggttcaccataaatgaggagcctcactgacagtggaagatgcacaggaaaagaaagaagactatgggctgcttccttagaattgtcttcctgcttgctgtgttactgctagagcttcctgtgtgggctccatatggtccctattcttcccaccactcatgaaaacaccaaagagcaggttcagagtgaccacagccaagccccagctctgccagcaggcccccatcttctcctgctctgatgtggggattgtgcggttggctttgtttcctggcttctctcttcttcctggcatctctcttcatgttgctaggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggtgagtgaagaaagccaggtgggtggcagacagaatgctgtccccatggggtcctgtttgggtggtggcttcaggggctttgctgaaagaggttggtgccactgtttatggctgtggtcagtatgaagatgatgggactctgcctttcttcataagcattcagtatcttatatagctaaaatttaccttctaaaggtagtacttatctttacatttgagtttttccaggataaattctttataaagaaggcagagatcacatttacaaaattcagagctcaggccagatcctctctgaagtcatttgtttaatctaagctccaacctatagactcactcagttgcatttgcttttagaataaataattatatgagaggccttcaaaaagttcatggaaaaatgaaattaaaagagattagaaacataaaatataaactttatttctcaacataagctccatcaagttcagatgcttttgtaaggcttcataccaaccctttaatccatctgtaacgaactgagatactgggaatttaatcttaaggcagtctttttaatgttatttgctgaagaaaaatgggtgccctgccaagaccagcttggtgggggagaccctaacccagcagagctagaggaattaaagacacacacacagaaatatagaggtgtgaagtgggaaatcacagccttcagagttgagagccccaaacagatttacccacctatttattaacagcaagccagtcattagcattgtttctatagatattcgattaactaaaagtatcccttatgggaaaggaagggatgggccaaattaaaggaataggttgggctggttaactgcagcaggagcatgtccttaaggcacagatcactcgtgctattgtttgtggcttaagaatgcctttaagcggttttccgccctgggcgggccaggtgttccttgccctcattccggtaaacccaaaaccttccagcgtgggcattaagaccatcatgaacatgtcacagtgctgcagagactttgtttatggccagttttggggccagtttatggccaggttttggggggcctgttcccaacagtgccctttaaaggttttttaagattaggaaacaaaaagaagtcaaaaggagctaaatcaggattatagtgattttccatcaaaactcttgcaaaattgccattgtttgatgagaagattaagcaggagcattcatgtggtggagaagaactctacggtgaactttcctgggctttttctgctaaaactgtggctttctcagaacactctcaaaataagcacatgtgggccaaggatgtttctccccaatgttgtaaaaatgaatgggtgtaattagtcaagggcaaattgtaccctacaccttcagaggcccttgctctcctcccccaagttacgagcatctatagttatccctccctcctgccctcgctccctccctcactctcacctatctatcatctatctatcatctatgtatctattttctatctatctatcatctatctacctatatctttaactgagagatttctcgtagcttttctttatagagcaaaggtaagttagagtagaaacacctgtctctgttatgtcaagtccttctgggctaaaaaactaggagcttaggaatatgggttccatctctagttcctgatagttcactgtgtgtctgctgaaagattctttctgtatttaaatgttttgattttatgacttaatgttttccccaaatataaaaattgtgttcctgtgtaacacatcacataaagacaacaaaaaatataagaaaatgtaaacaaaattcatgtgtaagatactccaccctcaaaaaccccactgggaacatctctttttttttttttttttttttgaggtggagtcttgctctgtctccaggctgaagtggcacgatcttagctcactgcaacctccgcctccctggttcaagcgattctcctgcctcagcctcccgagtagctgggattacagcctcccgccaccatgcccagctaatattttgtatttttagtagagatgggatttcaccatgttggtcaggctggtcttgaacgcctgaccacaggtgatccacctgccttggcctcccaaaatgctgggattacaggcgtgaaccaccatgccagacccattgttttatttttaattgacatataataattgtacatatttatgggatacatactgatgtttcattatatataatatacagtgatcagatcagtataattaggaaatccatcatctcagacatttattatttctttgtgttgggaacattcaatatcctccttctagctttttgaaaatatgtcatatattattgttaaatatattcatcctacagtggttcagaacactataacatattcctatgatgcaggtgtaattttattttctacacttttattttagattcaggggtagttgtgcaggtttgttatataagtaaactcctgtcatgggggtttgctgtatagattgtttgtctcccaggtactaaacctggtatccaatacttatcttttctgctcctccccctcctccctccctccaccctcacgtaggccccagtgtctgttgtttccctctttgtgtccatgtgttctcatcatttagctcctacttataagtgagaacatgtggcatttggtttcctatttccgtgttagtttacttaagataattaggccttcagctccacccatgttcctgcaaaaacatgatctcattcttctttatggctgcatagtattccattgtgtatatgtagcacatttctttatccagtctaccactgatgggcatttaggttgattccatatctttgctattgtgaatagtgttgcagtgaacatacatgtgcatgtgtctttacaatagaatgatttctattcctttgggtatatacccagtaatgagatggccgtggttggagagtggttggtatgagttcagttcttttgcatttgctgaggattgttttacgtctgattgtgtgttccaattttactgtatgtgctgtgtgtgatgagaagaatgtatatttttctggttttgggtggagagttctatagatgtctaacagatccatttggtctagtgttgattcgaggtcttgagtatcttcgttaattttctgcttcagtgattactgtcagtgaggtgttgaagtctgccactattattgtgggggggtgtctaagtctctttgaaggtctctaaggacttgctttatgaatctgggtgcccctgtgttaggtgcatattatttaggatagttaagtcttcttgttgaattgagccctttaccattatgtaatgtcctttttgtcttttttgaactttattggtttaaagtctattttgtctgaaattaggattgcagcccctgcttttttctgctttctatatgtttggcttccatccctttattttgagcctataggtggcactgcatgtgggatgggtgacttcctttttctttgtttgtttagcggctcttttaagattgctgcaggatattgtctcatactttaagcagtcctgcatttgttaagtccagtcacaaggtaaggtttgaggagctcataataaatgaaatgcacaattatataatcttttcaattcctacactagtgggtggaggatagggattcaagaaggcagaggtcacaccaactggacttgtgaccacgagcaggtgctggctaatcctgaaagccactggatcttgtctcttcgctttctgtcttctaggatggcagtgctccctatggggccaggtatgtgggctccatggtggctgacgtgcaccgcaccctggtctatggaggaatcttcctgtacccagccaaccagaagagccctaagggcaaggtaattctcccttgtccactggctgtgcatccggtcagggaggtgggggagctccctcccgtcacacctgctgtttggctactgcactgcttcatggcatgtctgtgtggggatgggcaggggaggaaaaatgaactctgtttcccttgagtgagtctccaggctgtgggaggtttgaagaagaaggcgacaggctgacgttatgtgactggtgattctcactggtcttaccccctccagcctcacacccaccgttcaccatgaaccagctgtgtgtctcactttccacaggctgcatctgacttttagcttcagcaccagctgatctgggatgatggtccctatagggagcctaataaaacttatcaacacacttcccagaacaaatgcatgtaaacgtacacattacatacaaattacacgttgagggagttcactgatgccctgaagtccgcccaagtatcccctagagaatttccaaacctcagaataagaacttctactcagaactcagccaatatatctggaaaggtagttcctggaaggtctaattgcaacttaatgatgcaaaacttaaaatacttgtattatcaagtgagaaccttatgatccagctatcttgcagagaacctcccataaaaatgcatctgaattttagccaatcacagaaatcgtaggtaagtagtcaaatcaaataaaggcctctgttttctctgacacaccaacaaccagcgacacatttttctgtctctcagagtcaccttgagatttgaattattcgaatgctaagaatcaaagccacgctgagagatctcacacagcacatgaagccagagagattttaataggttggtgtatcaggtgtttctcttcatgtgagtgcttagcccaggtgtattcacccactgaactaagaacactgataagcctgcagaagtggtgctgaaggaaagctaagcaccatggaggactaagtgaggcaagtagaagacatggacaatggacattctttttttttttttttttttttttgagatggagtcttgctctgtcgcccaggctggagtgcagtggcaccatctaggctcactgcaagctccgcctcccaggttcacaccattctcctgcctcagcctcagagtagctgggactacaggcgcccgccaccacgcctggctaattttttgtatttttagtagagacggggtttcaccatgttagccaggatggtctcgatctcctgacctcgtgatccgcccgccttggcctcccaaagtgctgggattacaggtatgagtcacagcgcccggcgaagacatggaaattcttagaaccactctggtcacttactcagttacattggggagaacataaagatcagttattactaattattcaaatgatcgtaaatgagtcagaaaatactcacatgggatcacatactcatgtcccttaagcacatgtcactccatagatagatctgcgtttgctgcgcataaccaccacccatactgaaagttctgttggatcctaatctccgcatttctgctgtcatggtccctgtgccgacgtctctgtgtgtgtgtgtgtctgtgtgtgcatgtgcacactcctatcctgtgtgtgtctgcatctgtatagctgtgtagatttaattgcagagaaagtacaggtcatggctggctgcggtggctcacgcctgtaatcctagtactttgggaggccaaggcgggtggatcacgaggtcagaagatcgagaccatcctggctaacacagtgaaaccccgtctctactaaaaatacaaaaaataattagccaggcgtggtggcatgtgcctgtggttccagctactcgggaggctgaggcaggagaatggcgtgaacctgggaggcggagcttgcagtgagctgagatcgcgccactgcactccagcctgggtgacagagtgagattccatctcaaaaaaaaaaaaaaaaaaaaaaaatacaggtcacatgtcacatggcctgcaggccaaggtgccatgaagccctgggcattttgatattaaatttcctacaacaggggcatctgaggtcagaacaaaagtaacttggctccaagacaagcgcattaggtactaatgctgagctttttttgattaaagtagttgactcaacaggataattgattacaatctgagactttattatctgataccccaaatcccccacataaaaggggagaaaaatgctgagcgctataagctgtcaaggtgagagtctccttggctagactgtcctggacagcatggcctccagtgtccctcctgtgggtaatgagggacagaactatctgcccccagacagcccgcatgcaccacaacttttttacacccttctggacacccactactttaagagccagaggtctagggtgagggcaccttacactgaccaaaatggcagtaaatacccccatggagtcttcacctactttctctcgaatgcctggatctccagcctagaccaaaggcatcatgttcctctccttaatatatataatatatacaatagaaaaaatatataataacattatataaatatataacatattatatgtaaatatatattatataatatataataacatataaatatataatagaaaaatagaaaaaaattaccataatatatgactctttctcaaagtagtttaaacatatcaccaaaacggactggaagaaaagaatggtaaggaaaggctgcacatagctgggtcaaccatttcgtaaggtgataatggagaatgaacttttgggaagttacacaggttgcactgatggggagaaaggagaagatgatactgagtcatgcacagcagcagggcctcggccagaacgacaccctgaatctaaggtgatggggttgtgtgttgtgagtcaggctgggggcgtcatgacatcatcacagaaatagacctaaaaagtccattcaatccaaccccattcatttcaattcactgcgtactcacaggacacaggcagcctcctgccagttctcatgtgcctgcaggagggttagagaaggccttccttcctctgaacagcagccctggatcttgtgcagagactggcaagcagggcacaggctgatttcaacccagtttctgccctcggctgggacccctcgtgcaggaaacagtggccttgcttggacactttcttcgtttttgagacaggctcttgctctgtcacctagactggagggcagtagcatgatcacagctcactgcagccttgaactccggggctcagttgatcctcccacttcagcttcctgaatagctaggatcacaggtgtgcgctaccacacctggttaatttttaaattttttgtagagatggggtctcactatctcaaatggggtctcaaatgcctggactcaagcgatccttttgcctcggcctcccaaaatcctgggattacaggccggagccaacactttctctgtgtcggcactactgagaataaagatagtacagtgaccagctaggatggacagcagcctagagaggaagccaggcattaaagaggcctcagtgtgatgagtggtaccagaggggaagtacaggatgctatgggagtgcaaacgatgggatttcacttagtctaagggtcaaaagacaagaccattgaaacaccggcaaactagttagacaagtcaaagcttaagatgtggagttcctccacacaatcccagccactgtggctgtccccagagagacaagccggcatggtcaaggtgaccttactgtcccatccaagcttgactctttaccagccttgaggtctcacatataaaggcttccacccaggcctgcagcatcagtttgcttcttgttgaaccaagaaatagatgcctagatctcatatttccaagtcaagaggcaggtctctcataagcacaaggatcacaagatgggtagatacatggctcagtcacctggccagaggggcccccaaggcttctggatgagtgccatctgatgcatctggcctgctgtaggctctaaagctcgggcccactcttgcaaggtgcatggtgcgctcatgctagccagatggaagcaccgcagtacaaactcctcccccagctttaggggcatggctcgggacatttggccacttgcagagtttactcacctgcctctgttcctccacagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaagtgcgactttggcttgtcttctgtcagaaacagtggcaaatatggttataattccgtctgtcaacccacataattggcggctgcatgcttgtgggcaaagagtacatagattagttaagaatttgtcagctgggtgtggtggctcatgcctgtaatcccagcactttgggaggccgaggccagcggatcacggggtcaggagatcgagaccatcctggctaacacggtgaaaccccatctctactaaaaatacaaaaattagccgggcgtggtggcgggcgcctgtagtcccagctactcgggaggctgaggcaggagaatggcgtgaacccgggaggcagagcttgcagtgagccgagatcgcgccattgcactccagcttgggtgacagagtgagattccatctaaaaaaataaaaaataaaaattgtcttgattggcttgaaatttgaacctagtgtcttatcctgtagtgattacctccctcaaacacatgtaaatttccaacttaatatcttagaagagtatttgtgtcttattttggataaatttgagttagaaatctcatggcaattaaattctgaaatttctgattgagcctatcttaagagtctataatttggatgaccaatcacagtttgaatggaaaatggggtcacttattgttaaagccagaaacagagtcaatatttagaaattaactacttttctaaacctcttaaccttgcattttcagtttttggggaaatgttttaatctattctagggactaactggtgtacactggttaaatgactcgtcacttgtccaaattatgttaagactggggaggggttggcttatgcatctgaaatctcatcttgttttaggaagaattgctctgaatatctatggacctggaggctaagaaagacattcatgaaagattgacaaatcaaatcaaatccagaagtatttaaagcaaaggtgcatcaggagaaagtcaggcttaacctagaaattcaagaatgattcaacacggaaaaatctattacagtaattcattaggttaggggaaggcagtgtcgggtgggaccaggcaaggccctggaggaagcaaggctctcctttcccactttagcttgggcagggtggggcatacagcccacagacacatttcaacttgagtgtcattctgtacgcaacatcgttcctcagtctagcatggcttggcaactttagcagacacagcaaaatcttattacacaaccaaaaaattttcaccttctcaaaaaggaacaaagattttcttcttttcccaaaatgaaaacttcataaaacatagatgaaagatattaaagcagacacaagtaaatggaaagatatcccatgtccatgcactagaagaatgttaaaatatctatatcacccaatgcgatctacagaatcaatgcaatctgtgttcaactacaagacattcttcatttaaatagaaaaagaatcttaaaattaacatggaagttcaaaatacctcagatagacaaaagaatctggaataaaaagaaaagctggaggcatcacactacctgatttcaaaatatactacaaatctatggtaagcatggtactatcaaaacagtatggtactatcaataaaaggggcaggggagagacagagagatgaacgaatgagacagacagacatagacaagtgaaacagaatagagaaatcagaaataaattcacgcgtttacggtcaactcatttttaacaaaggccccaagaacacacattcgggaaggacaatctcttcaataaactgtaccaggaaaacccaacacccacatgtacaagaatacatctaggccattaccttaccatatacaaaaatctactcaaaataaagatttaaatgcaggacctgaaactatgaaactaccagagaagaaaacataggataaaatgcttcatgaaattggttaggacaaggaattttcaaatagacatcaacagcacaagcaa

SEQ ID NO: 14480 - DNA, 10932 bp, Human
actgtctggtgaatacaaaccaaactgaatcaaataacccagtgcaaccagctaactaaccacctccccaggtgaaaactaggaggggcagggaagcggtggaaagaaatgggtttgtggttttctggtttgtggttttctcatttatatgagtagttgttatgcttgaatgtgaagttcttacacttgagtgtgaaggtcaccccttcacattgcatagtgcaatgcagattctcaggccccgccatggaaagtctgacagtgtgtctaggctgtagccccagaatatgcatttcttttctttttcttaaagaggcaggttctcattctgtcacccaggcatgtgcagtggaatgataatggctcactgcagcctcgacctcccaggttcaagtgatccttcagcctcagcctccttagtagccacaggcacatgccaccatgcctggctaattaaaaaaaaattttttttcgtagagatggggtctcccagtgttgcacaaactggtctcaaactccttgcctcaaatgatcctcctaccttagcctcccaaagtgctgggattatagggatgagtcatgaccccggctgtgaatgtgcatttttaataaatatcccaggtgattctaatgcaggtgctctgtgggccacccttttgaaagttatgggaagaaattacctggaatgttttgctgggatgacttccttctccagctgcgtgatacagatgcccctgcttacgctcagctgcaggaatctaggaaaagaataagtgaagttcgagaaattgcatatttttatttctgcttaattcaagcagagagtagttaagctgaaagatttgtttggggctgtcttgatgaccaaagaggtcaatccagtgttaataaagaagatcaggctgggcgcagtggctcacgcctgtaatcccagcactttgggaggccgaggcaggtggatcacgaggtcaggaaatagagaccatcctggctaacacggtgaaaccccctctctactaaaaatacaaaaaattaactgggtgtggtggcaggcgcctgtactcccagctacttgggaggctgaggcaggagaatggtgtgaacccgcgaggcggagcttgcagtgagccgagatagcaccactgcactccagcctgggcgacagagcgagactccgtgtcaaaaaaaaaaaaaaaagaagaaaatcattaatagtaagaaatcagtggttaggagctgtctccttaaggggctcccttccctagtgttagaaaaactctggaccacatgacccagtgggctgtgtttttaatgaaaaaatggattacggcacatgccacgttctaagtgtaggtattattttggtaactttttggtgtgtgtgtgggggcactggtttgtgatgtaaaatgtgcttcttcccatgcatcacggttaaaacactggacagcatctgctctaccccataatgactctggggagatattctgagttcctacgtttctgagaatttccctgacgtgtgagtgatatagaccacatgctcagcagagtatgggctgcagcggcaagagctcacaaaactgatttcctccgcagactggctgccctgcagcccagtgttaatttatttaaataaagatggagtaggcaggtgacagagatggatgcccgtaataagattaaattagtgggaactggcaagaaggcatgctcttttttggaactgatagtggagagatgagggaatatcacattagaaaaattggaggagggccctaattggaaagaggaatccagatgcaggaaatctgggttctggtgggaaggctgccgtgataatctaatcaggatattgctgatgtgtaggggaaggcccctctgggaagatgccctatttcattagaagagcaccttgagaatgcctcctgttaatggttgaactgtaaaaaagaatcacaaaacaaaacaaaaacattctttgatttctttcttgctctagaaatcaactgatgagccttctgagaaggatgctctgcaaccaggccggaacctggtggcagccggctacgcactgtatggcagtgccaccatgctggtccttgccatggactgtggggtcaactgcttcatgctggacccggtgagagacctcacaggaggctgggggcttggctggtgtctgtgagcaaatgaatgatatgtgtgggggattggcaggggtatgtggaggtgggaggtgatgcccatggagggacagagatgatgatgtgtggtggaaagagggcaggagaccaagagagagtgtatgcctcccgagcagactatggaggtgagaaatgccatctcagactggcacaagagggggtctttgttccaatgtgaattcctcagagcagctgttactcaaatgacccaaatgccaggtccaggcaggccatagggatgatgaagtgtgctggggaaggaaggccggggggcaagggtggaactggggtgaactgaagagttccagcaattacaattgggaggagggggcccgccttgccaaggcttctattaatgcttcaagaaacactggattgtaaaaaacataatgtttctgcatgtgtgcaacactatgctggccaactaaaatgcatttatggacctgatggggctgtagatattctgtttgccataaactgtatccatccatttctagcttttctactttagtcaccaaaaggctgttttcctgagacgaatgggtgtgccaactgaagcagtggacgacattgcttcttcaaaaatagctcccacatttattcgtgtacatttacacaaaccttcagttaactggtgcagtctttctttctttcttttttttttttctgagatgtagtcttgccctgtctcccaggctggagtgcagtggcgtgatctcggctcactgcaagttctgcctcctgggttcgagcgattctcctgcctcagctcctgagtagctgggactacaggcgcctgccaccacacttgtatttttagtagagacggggtttcgccatgttggtcaggctggtcgcgaactcctaacctcaggtgatctgcccgcctcagcctcccaaagtgctgggattacaggcatgagccaccatgcctggccaacttttttaacttttagagatgtcctcctatgacattagtgaactatgtgtaaagtgctttttgctggcaaactgaaccccaggaacagacaaggaataggaaccttctgtgcgagataggctgctggaggtgaggccgggtctgtgtgtggcaggaaggctaactcaacacaggctgcctttgtcccaggctgtcagggaagtggactttcacctccttggaagcatgggcacttaacaaataaacaagggtagggtaatagcactagttaaagtcgccaaatgtggtgacctgggtaggggtggggtgggggagttagtggcagaaccagagcaaagttccacctgagcccaggatggaatttcgggcaccactgatgtttgctgactgtgatttgccgggccctgactgcttcccattcttctggtgccttctcttgttacctttgagttggtggaagcagagaaaacattcaatcccttcttgtttccagattgcaggggagcatccctgtagggaagcttctgtgtgtttgatagtcttttgccctcctcagtcctgaatgtttggaagcgcaatgcagggctgctgggatttgattccagcccttctgtctgcggtgcctgacggggctgagcctcccgccagggaggtgctaagtgcttcctctttgtttgcgcttgctgcaaagccaggctgacggtttctgctgaaaacactgctacagctgtactcgggtttccagcggcttcaactttctgggagcttttatgttttgtctctgtacacagacttccctcctttgcaccatggacagtctggctgggccctgcgctctgcacccagcaactgttgtgagatggctttcttttctatatagttttttgaaagacatttatttatttatttttctaccaacgataaaagaatattccggtatacttgtggtcaaaaattttgaaaatattaaaaaaggcataaaagtaagaaagaagaatcacttccagtgacacctttcaatggccactgtgaattctcccctccctttctccctgtctgtctggtttcaacgtattccatatgggtaggaaccaatttctgctgtggaataaatggctaggtagagaggtgtcggtgggccttttttcttttcaactcttgtgtcaacgtcaagcccctcctaaatgggcagagcctcgatcaccctcttgccaaaaacacacaggaacccataacaatcctcaatccggagcaataggacttctgcaacacttttcccccaaattcaaatctcctttgaagagcctaaagcttaaaggcataagcttaaccctgggctatgtgggaagaggcagtctgagaaaaacttcacacgccagcgagcaaaggccatcggaagttacgtacgccagactcaaaactcagggttctactttgttctataagaacgcccagaaaggagaactcccatcaaggtagaaatgtaaagccgagaacagcgctgagcacttgggtgtaactcagggactgatcctgcggtggcccgtctctcctgagagcccacctcccgcctgaaccaacccttttttctgtttggtaaaggcatacacatcttatattgctttggacacacggttcttactctcttgcaggcttagcagttgtttcacaagtctgctctccctatttttgtgtggtttctttcttgtttgactgaaatcatatgcaaacaaagtcgaaagtgtctgttatcaccctgatggcttctgcagcattgtcttgcttcccctcaccccattcacagttcccagagagcctggcaggtgtctcggggccccaagatgagtggtgcccgtgcgccgcgaccccagcccagcgtagcccagcccatcgctcgcctcatccaggcctgggggacccagtgcgctcgtcatctctccacctttccttccttgtctaaaaaggccatcggggagttcattttggtggacaaggatgtgaagataaaaaagaaaggtaaaatctacagccttaacgagggctacgccaaggactttgaccctgccgtcactgagtacatccagaggaagaagttccccccagtaagtgagggcccggggagggtggtgcaggttctgggcatctggcaccagaggccgttctggaggcaggggcatcccccggagatgaaagggatccttgggatcgagggccttgggcctcatgtggggctcctgagcagtgtggaaatctattggttgatgacttaccctaaaggtgaaaggaagcagggatggagtggattgggcttccgtctacactgagcccacgatgaagttctcacctcagtactggagactggaattctcaccctgagacatcaaaaatcagtctccatgtcagcctttgctactttctcttggcagaagaaaattaggataataaagttaaacaaatgaatgaattcatggcagtaaaacatcttcccttctggggtccatggtcccagatgggatgaaatgtggttcccccactcaaatgcccgtcaagtggtgtctgccccttgctaggcctgcctgaggtgcatctatcagttatctcgagaccgagagtgcccatcgtgacatctccctaaagaggttacaagctagtgaatatgaagagaagaaatggctgtgtggagcttgctctatatggaatatctgattttgtcctttctttgtttaaaagccatcgatggctgctgtttgctagagatgaagctcaaatgtttgcaggacgttcaaggaggcctcagatctgccccaggctctctctccagcttactcatctctcctttcaccttatcctggattcccctcctgcccccaagctccgcacacgcacacccgagtcccgcaggctcctcctccaggaccatatccctctccacattgctaagcagacacttgtgcagtttcctctcctgtaaattacacactgcctcccacccctgcccggttccttagcttggtaacaaactttctcagcctttaaggtgttactaaatggtacagtttctgtaatgcctgcctcagccccataaccagaatcaaccataccctcgttggggcttctgtgggtaatctgacctattgtgagatgatgagaggctgtctccatttttccattttctatttattgggaacaggattctcatcacattttttagcacagccccaaatacataccttgtaggtgctcggtgaatggatgtggaatcaaagaaacttaggagacaccaagaaaactctctttcttattttctgcaatcctaattcttgctggtcttaacttgcaggataattcagctccttatggggcccggtatgtgggctccatggtggctgatgttcatcgcactctggtctacggagggatatttctgtaccccgctaacaagaagagccccaatggaaaggtaagggtgtcccctggagagggagtgaggagcagatttcacttgcagcccacgcgatttagtttaggaagaagaaaggttttgctagctattacgctccatgctaggttgctacgtgtgtctgtagcatattcttttgtggattaaaggtaaagccagacgatatcaactaaagataaaaatagtctcttgagagcccttccagtgctatggcaaaagagaatgaacggtcaggacgaggactgaaagtccttagggcttccagtggatacagggcttggctggggcaaaatgaattccattcataaagtgaaatgaaacaacccagcctcacttccaaggcagcgaatcaaatgtgtatcctcagtagaagtcttctttgattgctttcaaaaggtgtaaaacagaggtaactagtgagtcaacatccactacttggaaaacgataccttttaggggaggaaagaatctctggggaaacctagagctttcaggtgagccgtcaccaccgactcactagtccaagcccatggtgttcccagcaggctgcagggtggctgtgctccctcacgctcgctcagagctgccctgctttccttctgccagggtgacagtgtgcttccttcccaagtattgtgtccttcttatgttttcccagtggacagatggctttttaggcagagtcttactcgtcgcccaggctggagtgcagtggcgcgatctcagctcactgcagcctctgcctcctgggttcaagtgattctcctgcctcagcattctgagtagctgggattacaggtgcccgccaccacgcccgactaatttttatatttttagtagagacggggtttcaccatgttgaccaggctggtcctgaacttctgacctcaagtgatccacccgccacagcctcccaaagtgctgggattacaggcatgagccaccacgcgtggctgcctttttttttttttttaatgcaagaggagaacaggaacaacagttcccttaaacacaaaacctgtgtgtttggatgtatttgggtctgtttgcagcatgtggcatccagaatgaaggcatttctatttactgaaaccatcatccagctgtagctgcctcgggcatatcaacctgtgtggttagcctgctttccagcacttttctctaaagtcccccgaaattgttcctgaacacaaatattgaggctccttcttttttttttggtttttcaaaactagccatgacacctatgtggaaatagactcaggaaacacctgcagaaagctgtcgctcagtaggcagactgcatgaaaaggcatacaataaaaaagttaatatttaaaagtgaatgccaagacgtataatacactgaattccaacccaaaagccttcggagaatcgtaaaaggaatgcacacagagttgcaaacaatatcacactgtttggaggagccggtctgctttccagatgtctgtagccagacaccaccatggattttttttattgcttttagaataggtgaagctccatccaacacacacagaatcactcattaagtccagtttccatggtataaagagaaggcaatgatcgcttctgccaaaatgtcattctgtccagtatgcaggtggtctgtctcacatttgcatcgggtaatctattgctggcactggcttgatgaatggttgaatttaaccaaatggttaactgttttgtctcagatgcaacctggggtgggaggaaacttttacagcctcacaggaaggaaaaatacagtattcgttcccttggaaactcccaccagctctgcatgttttgctgcagaaaagtctcttttttacgcaataccttctgatacaaggaggccgctacccggtcttgttttccagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaagtctcccttgctttgtgtcaaataataatgatgatgacaataataactgctgatgcatataacattagataactcatttaatcttcacaataacccaatgaatcagatactctgaataatccattttatagatgacaaaatggacgaggagaggtgaagtaattggctcaaggcttccagccaatgagtggcagtgtggggacctgaatgcaggcagcctggccactgtgagccagcatacggcttctccttcatgtcgtcccgttcaggcctggcccatcattccccagccttgttcaggattgcagctgaggaaccatgcagcctgaacatggcgactcacgccctcctagaaatgggggagctaatggcttagtggtggtaactgcatgtgaccctctggcctcccaaacatggatgtaaccatctgaatcccaagtgaaagtttactgtttacccagtggtgatttttctttttctttctttctttctttctttttttttttttttttttgacgcggagtcttactctgtctcccaggctggagtgcagtggcgcaatctcggctcactgcaacctctgcctcctgggttcaagcgattctcctgcctcagcctcccgagtagctgggataacaggcacccatcaccacacccagctaatttttgtatttttagtagagacggggtttcaccatattggccaggctggtctcaaactcctgacctcatgatctgcctgcctcagcctcccaaagtgctgggattacaggtgtgagccactgcgcccagccacccagtggtgatttttctataaaagcacggcacttaactcacaaaggctaatagttcctacagtctagttaccataagaaaaaggattcactacaagaacagggtttaaggaaatgcaatttgttgcaagcaagcaggcttctcactaaactctctatagaaacagtttctccctccgctaaccctggtcttactggaccagagtccaagatcgtggcaagctctgtcaggcactaagtaacacctgtggccctccttgagctctagatataaaatggatctatccatatgattccacttgggaactgaaaacatgtgtgtatgtgaatcctgcttcttcccctccaaacactccccattcatttcacattttcccagcaggaaattgatcttgagcattggatctgcttctgcccactgaccagacagacccaaagccaatatttctccactccagctggggctgccctctgggaaagtcccctgacgcacaaagcacctcttgagttttaaacttcttgtaactcagctggcatctggttctcaaagcatgaagggagagaaatatggtctgggagccttttccatatatatatatcagggtgcagtggctcacgcctgtaatcccagcactttgggaggccaaggcgggcgggcggatcacaaggtcaggagatcaagaccatcctggctaacacagtgaaaccccgtctctactaaaaatacaaaaaatagttgggcgtggtggcgggcgcctgtagtcccagctactcaggaggctgaggcaggagaatggcatgaacccgggaggcagagcttgcagtgagccgagatcacaccactgcactgcagcctgggcgacagagtgagactcgtctcaaaaaaaaaaaaaaaaaaaagaaaaaagaatgagggtctttgcagatctaattaaagtaaggattaagatgagatgagcctagattacctacattaggatgggtcctcctctgaagccatgcatttttgtacaggttcatgacatggcaggagcctggaggcctaagccaccgccatgtcgatgtcagcctgggaccagaaggagagacaaacctttgctgtgctaagccgtggggatttcaggtttatttgttgctgcacgataacatacgctatcctgactaaactagaccaagcttggcaatatttttaacctctctgagtct

SEQ ID NO: 14481 - DNA, 9855 bp, Human
  misc_feature (1)...(9855): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagagtaagaaactagctgagcaacgtggtgtcacactatacacccattaagacaacaggcacatgtgtcatgtccattttgtggaaaagatatgtaaaataattttaagtaaaaaagataaatataaaaaagtgaatgcatacaaaacaatttcacaaaattgaatgttactcaaaaatcacagctcattttaagctgcacaaaatagtcatttttttctttataattgctcaaattcataatcaaacagaagaaagttcctgtcttggaagtagtgctatgccccaattcttccagagccagtactttaaacaattccatttcattattttcctgtagactaattcttaggacatcagcatatctctcttcaagcattaaaaaaatctctttagagtcagtggatcaatagacagttcctgttttccacacaactgaaagggtggagcccccaaaccacaaggggaagaaggaagttaaaagatgttaaatactggggccagctcaccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactgtaagtctactctccataattccagagaattagctacgtatggaacagacactaggagagaaggaagaagaagaaggggctttgagtgaatagatgttttatttctttgtgggtttgtatacttacaatggctaaaaacatcagtttggttctttataaccagagatacccgataaaggaatacgggcatggcaggggaaaattccattctaagtaaaacaggacctgttgtactgttctagtgctaggaagtttgctgggtgcctgagattcaatggcacatgtaagctgactgaaagatacatttgaggacctggcagagctctctcaagtccttggtatgtgactccagttatttcccattttgaacttgggctctgagagcctagagtgatgcagtatttttcttgtcttcaagtcccctgccgtgatgtgggatttttatttttatttttattttattttattttatttttaaagacagtctcactgtgtggcccaggctggagtgcagtggcatgatctcagctcactgcaacctctgccttctgggctcaagtgattctcgtgcttcagccttctgagtagctgtgactacaggtgtgtaccaccacacccagctaattttttgtattttcagtagagatggggtttcaccatgttggccaagctggtcttgaactcctggcctcaaatgatctgcccacctcagcctcccaaagtggtaggattacaggtgtgaaccactgcacccagccgacatgggatttttaacagtgatgtttttaaagaatatattgaattccctacacaagagcagtaggaacctagttcccttcagtcactctttgtataggatcccagaaactcagcatgaaatgttttattatttttatctactctacttgattaactatctttcattttctcccacacaattcaagatgtgccatgaggaaaagttattttatagtttagtacatagttgtcgatgtaataatctctgtagttttcagattgaattcagacatttcccctcaatagctatttttgaatgaatgagtgaagggatgaaatcacggaatagtcttgttttcaagattctaacttgatatccaaattcacctttagatattataagaaaatttctatcagaaaatccttatgtttttctgattaaaaaaagcatttttccatcagcctatgtatctgctatgaatttacaaaatctactcaacagctctgttgatttttctgttcttggctgaatgttgcctgagggatgggagcacgggaagggtaaaagcaatggaagaaacatgtattttaatattttaaaagtatgttatattgttcgttggtgttacaagatgatttgcattacaaaaggattctcttacaagtcccttatcttaacactaaagtgctaagatattttataagtaaatctttatacttataaaacaaatcagtaaaatagaagtagctaagtagaactgattttgctatagagtataagtcacttagtgttgctgtttattactaaaaataagttcttttcagggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtggtaagacaagctaatatttgaccaatctggttatacttacaagaattgagactcaatacaaatgaaaaagccttgaaaggttcatgagggacctagaaaaactacatctcaacttccagaaagtcattattattttcctcataattccctgagtaagaaattaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaacattttgccatagttgcttcttctatgccttttttttttttttttttttttttgctgagagttttttgtttggttttgttttgttttattttgagacagggtctccctgtccccaggctgtagtgcagtggcaccatcacagctcactgcagcctcaagtgatcatcccaccacagcctcccaagtagctgggactacaggtgtgcaccaccatgcctggcaaatttttgaaatttttagtacaggcaaattctgtgttgcccaggctggtcttgaactcctgagttcaagcaatcttcccacctcagcctccttaagtgctggaattacaggcgttagccactgtacctggctactgctgagagacttttaagtgaattaggaacatgatgatattccatttctaaattctttagtttacatcttcaaaaaatacagttcctgtagaattattattgtaaataacaaattaacttaaggatttatttatttggagtgaaacaaatattttactgaactcataaaaatagaaataccatgtggaatcctcagtgtcaaaaatattgcagaaatcttgcaaagttgatattattaaattgttaaatattaaaattcccaataaagaacattaatcttatttctaaaatccagttaattaaaaaaatttatattatataataatatttggtcattaaataaaaattagaaaatacaaataagaaaaataacacccataatcttactacccagaggtttataaccatgggtaaattctggtatatattcttccagaatgtatatcaatcatgtgtatgaatgttaaattatatcatacacatataaacccacatacaaacatgtaaatactgtgtgcttttgcaaaaattaaattgtattatacacacggctttacaatttgcttcttatcacacaaaattatttgcatgtcagcaaatacaaatcggtttttaatgatcttttgctccattttccagatgagaaaaaaatacaaatctgtatcatcattttaaaagaatgactagaattttaatatatgaatattctataatttactgatccaattgttactattgagcacttaggttgtttccatttttccctcataaattgctatgaatagctttttgtatacatctttgggtgcatttcttatttcttttggataaattttcaataatagaactgctgagtaaaatatcactaggtgtttttttacagtgtctagtgcaaagaagacctttaatcattttgttaatacttccagagcttccaatgactttggtaaatgaagaaaaaaatgcttcatttcatgctgaatgggagagaatgaagagagttttccccaacaattacacatatatggactcatagaaaataatatcttaccattctttccacagcctaacagaaaaaagctggctaaacctaaatttaaaataaaatatctattaaagtttttattccttaccacctgtctttcagctttgctgcaagataacatcgctgatgctgtagcttgtgcaaagagggttgtccgtgatccacaaggcattagagcatggtatgttttaagtgttaaaagggaaaactatcttactctactgttgatatatacaatgagagcagacttttaaagaccaaagtatgctaatgacacctcaaaattgcagcttttggcttatgctaaatgatgtattacctacatccttgaagaaacaatctactttaactgatccagaatcttactcttttactcctcaatttattttaggggatttctagagttttaagatgcttcacactctatcagttccttgtcatatcttgaaattctttttagaataagtaagtgtgggccgggcacagtggctcacgcctgtaatcccagcactttgggagaccgaggcagatggatcacctgaggtcaggagttcgagaccagcctgcctaacatggcaaaaccccatctccactaaaaatacaaaaaattagctgggtgtggtggcaggtgcctgtaatcccagccactcgggaggctgaggcaggagacttgcttgaacccgggaggtggaggttgcagaggattgcgccattgtacttcagcctgggcgacagagtgagactctgtctcaaataaatacataaaaaataaacgtggaattcactttgcagttgctgctgtacaacgcacattactcaatctttatgttcggcattctatgctctactgagaaatttgggtaggagtgaagtattttgtatacatatcttcatttaataaatagcaatagctgggtctatcttactattttatctattgataaaatattttgtttccccaaggagtgcgaagtatgtatattacaatgaagatatgttttaacctttcaccatttgcttcatctttttctacagggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacatgccttgtctgtttttatttagactcctatagtgtctctgaagaaaagaatacagatatttgaaaaaatatgatttggtgctcttaatatctcttatatcgtcacttacctcacttaaatagtcagatattgctggagaaaaattcacaagcatgctgacaggtctcactttaaattcataaccataaatctcaaatgagccctcaagtctgcctgaccattttagttacttctctacaatccttccatttttatgtccctagtctccaaaatgactgttactattttacttttcctcttctctcttcaaagcctcaagacacacattcagcctcctcctctgcccccttatcctccaccctcctctgctctcagcagataacctggcctcatattacacttctaaaacaaaagcaacttcataccaagctttcccttctacatcccaaagcagcagtcataccttcccacaggcccatccttccttccttccctcctattatcaggatgaagagcctctgctcctgccaacagcactgactccacatgcagtttccctcccatccctctcactactccaagtcaggctgtttcctgcatccctagtttgtcccttttagctggatcacctccatcattctacagtctgccctagtaaccttccatcttacaacaaatactccactgaccctacataatcctccaactgcaannnnnnnnnnnnnnnnnnnnactgcaactccattctctgctccctttacagcaagacttctggggaagtatgtctgtacttaccaactccatgacctcacctcccagtgtcttttcaaccctctctaatctggcttctatcctcacccagctgaaactgctcctccaggatttctcccatgattcctcagtgctaattccagtgatcatcttgttcatctcagcagcatttgacaaagtgaaccgcttcatacttttagcagttttttaatcccttggcttttccttatttacatcctacctcactgactgttctttctcagtccttcttgctcactctttctctgctatttaatttctaaatgtgagagtgcctcagggctcaagtctataataattttatatactacatattttacttatttgtctcttctcaccaaaatataacttccaaaatgacagaggtttttccactttttaaaaaaacattgaaataaactcaatcttttaaaaaatataaaagtactgtacaaagatcttttatttttcagaactgttttgagagtaaatagccaacatgatacccaatggccctgattacatcagtgtgtaattcctataaagacattctcctgcataaaacctcaaaacaattatccaaattaggaaattaacactgatacattactaccacctagtcatcagattccactcaatttcatcgattgtcccaataagaccttcataacaaaagcatctaattcagaatcatattgtatttggttgtcatgttttttaagtctctttgaatctggattatttcctcagttgtttctttctggactttttatgaccttgccacttttgaagaccacagactagttatgttatagaatgtacctaaggtttttctggtgttctctcgattccattaagttatgcatctttggtaggaataccacagaagtgatgttctcactgcatcctttcaggtggcattcagtttttgcagttttgatttgccccattattgatgatgttcacttggatcacttgattaaggtgaggcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14482 - DNA, 7740 bp, Human
  misc_feature (1)...(7740): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggacgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccgagaccgagagactggatatggggtcggggatcgggacttagggagaagggtgtatttgggctagatgggagggtgggagcgagatcgggtttgggagggctttagcaatgagacttgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaa

SEQ ID NO: 14483 - DNA, 8429 bp, Human
tttaaatgttctcatcacaaataaatatgtgaagtaatgcatatgttaattagcttgatttacccattctgcaatgtacatatatttcttttcttttttctttttttttgagacggagtctcgctgtgtcgtccaggctggagtgcagaggtgtgatcttggctcactgcaacctccgcctccccggttcaagcgattctcctgcctcagcctcctgagtagctgggatcataggcatgcgccaccacgcctggctaatttttgtatttttagtagagacagggtttcaccatgttgagcaggctggtctccaactcctgacctcgtcatctgcccgcctcggcttcccaaagtgctgggattacaggcgtgagccaccgcgcccggcccaatgtacatatatttcaaaacatcatgttgtacaccataaatatatacaattattaatcatatatgacatatgtatgtgtataaataaacaaatatatatatttgacaactataaaggtagaacttggaccagaatccaggtttcctgacccccccagtcataattccttgttaatgttaccaattacgaataatttttttttttgagacgaagtttcgctgttgttgcccaggctggagcgcaatggcgcgatctcggctcactgcaatttccggctcccgggttcaagcgattctcctgcctcggcctcccgagtagctgggattacaggcccccgccaccacgcccggctaatttttgtatatttagtagagacggggtttcaccatgttgaccaggctggtcttgaacttctgtcctcaggtgattcatcctcggccttccaaagtgcttggattacaggcgtgaaccaccgcgcccggccccttaagaagtcttcacattcctcttttacttaaggaattactgggcttcgtttctggagccttgtgagaagcattacactgtccccccttttttttttcttttttaaaattaattttcctgtaggaagcaagatcccatctgtcccttctttaggcaatgaagcttttttcacctttgcataaaagaacagctgagccccctttttaaattttcttttgtcttaccgtcccttgaggctagaagaggattctcaaggcacagagttgtgggccacaagaatccaggttgaggaaacggtgaaagtcctgagctgaaacaactaccttggggcattcaaggaacagcaaacagcaaaccgaccggcgagggtggcgggagctgggctggaaatcaggtgggagaaccggccagacgcccgcaggcgcggtacgcagatatcctggaatgcgctgggggctcttccctgggcgcggcttcagcaccccgcattccggtcccaccacgtccccacccacctggagaaggcggaggctgcactgagtgccataagtagtcgagaagggatgattttcaagacataccctctctttgctttcccccctttccaattctgccttgtctttttccttgttgtgggtgctggtgagggaaagcagtcaaggaagttggtcccaagaggggaatgctttcccttgggcgccaagaggcactgacgaggtgtcagagccttctgagggacagatgagactttggcccaaggccaggaagatgttttcagatgtgggccggaagacttgacaatgcggggtctccctcttttaaaaatatccatataatcaaagcctttgttgactggcccgctccggcccctcagtcctccacagatgcgccccagggccccagccccgaggtccttttcctaatatccgctcttgctctcgctcactctcctcaggtcgcctgctccgcccgctcccgctcccgatctctgattgctcctaactgacgtcactcccggtctgtccccgcccactcggtgctgccattggcagtcggtcgtgggtacgcggctcctgtgggggaggggggagctatgggagggggcgggaattcccgactctaggccggaagcgcgcggagaccatgtagtgagaccctcgcgaggtgagtgcgggctgtctggcagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtgatgagatatccatacagcctttctcatgcctcggtttcccccgtgcagtctccctgaataagtcacttgggaaagaaagtgtgagaagagaggaatgttcctggtacaggagtagatgagtcaccctgggtaggggaaggtcacaaagtggctggggccagggagctgcactctgctgaccaagcttccccattccttgccccatcttcctttgcatgatttttcccaaccactctggtctgtcttcctaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcaggtaagcctctccttttccccacactgctatgaatgcttggcttagggagggctctggggctggcggggagtgaccaaaggaggagggaaaggcaagggtagccattgtttgggttggggtggtcggccctggagggggtttgtttgcttattcccctctgtgcttcacccctacccagcttcccgccagaaagccctgagcctagtaagctgtttcgcggggggcgtctttttggccacttgtctcctggacctgctgcctgactacctggctgccatagatgaggccctggcagccttgcacgtgacggtgagcactggcctgggcatgtgacttgcgggaggggaatcacacacctctgggagtgttggtttgtggagattgattcatgtgccactccatgactgtgtggaagacttttggcatgtggtatgaattgtgatttttggttatggggcataattctttctatgtgttccctcccccttccccattccctgtgtgacccctacattcccgttgagacagtaagacactttttctcaggtgtgtgacttgctctatgggttctcagttctagctaccagcaagtgctccaagaatcatcttcactctctcaccactttcctaaagggctggagatagaggtctctgtaggcctgagaaggataggaagcgattccctgggtcttggtgttgctgacctttttaggctttggcccaaggaagtgggctgtgaggaatgatcaagtccacggcataggacttggtttattataggaaaaactgaggccgttggatagtggggcaggaaagtcatcctgggctctttccttttttcctctaaaactgaggaagtaacactggatgtatccctttgtgtgtctgtgactgagtgacctgtgtttccgtgtgactgcgtataagcctgaatgtcctgtgatatgtggctctatgtatgagtatttggggagatgggcaatgtgtgaccttttcatgtatgtctacatcagtgactctcaactaggagtgtggctttgcccctcaggaaacatttggtaatgtctggggatatttttagttgtcacaatggggagggggatggagggaacattgtgcctgctattggcatctggtaagtagagatcagaaatgctgttaaacaatctacagtgcacaagacagctcccatgacaaagaattatctggcccaaaatgtttttgtttgtttgtttttgttttgttttgtttttgagaaagagtcttgctctgttgcccaggctggagtgcagtggcacaatctcgactcactgcaatctctggctcctgggttcaagtgattctcctggctcagactcctgagtagctgggattacaggcatccaccaccacaccctgccaatttttgtatttttagtagagacagggtttcaccatgttggccaggctggtctcaaactcctgacctcaagtgatcttcccactttggtcttccaaagtgctgggattataggcatgagccactgcccctggccccaaaatgttaatagttccaaagctgagaaactttggtctacacgtaacactgtgagtgacaccataatctgtgtgtacgtatcattctgtgtcagtgttaccaattcactctatctttgtgtgactgagagtagccctgtgtctgtgtcagaccctaggtctgtgtaactgggctttcaccagattttgcatctcactcttccttccctgaacattttgctgctgcttctgcccacagctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagtatctgattcgtttgttttgggaaaggggtgggcatgtggccagcctgagagggcctgagtcccagatgtttacagctgttttaagattcttggtctcactgttttcactcaggacccgatagtccccttccctgaagatgacctaatttttcctcctttgtgtcttggtacttctttcccggtctccacccctccgcttcccttctcttccctcccctccctcttcctttcttctctcttcaatccctctctcctttccgttcgtagtctcagggctaatttagaactactcttcccagcttgcacctctcagggagtagccgagagggtggagccaagtccccagtttccggagtcagcagggctgctgggaagtggagtccgtttcctcctagtgctgcgtgactggggatgtgaaggagtctcgtaaacaaactacaattcccggcggcccccgcgcgcaacaggtcagggctaggctggggccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccgggtgaggggccgcgccggggagccggagcagagctgagcagttacggagcggagaccggagaggcggggcgggggcgggcgccgcagcgaaggaggcggaacagagcaggggacgcgggcgccgccgtttgggaggcgcaggttgagggccgaggggcaggaagaaggattttgccgggggagaccgaaacaccggagaggttcggggtgtagaggcgactgggggccgagtacgtgaggtgggagtgggcggagaggggagatgaagtccggcggaggtaggaggtgagtggtccttgtgcatccctgacggagtcccctcgaggacgctactgaagcatgcctggtattggggtatggcctgggaggagggctgcttgtctgtaacctggctcctctgagtttgtgatctcctccaaactggtccctctgccttctgcgctttggtgcccccgggaaagggccccttgagtggtttgaacgagcggtgctgtgtatagtggggcaggaagtcccctcctgcgtcccgtccttttgcttcctttttcaaatacttcttgtggtttcctgacgtgaatgaaggtgaggtccattgcttggtgttttgtcctggcctccttggaggagaggtagggttttgaatccgacaactgggtaaccgtccgaccataagttgtgtggaactctatggtttgctgagctttctagggagttggctgctttgtgggttagtgtgtagggtgccttggagggtcttctatgtgttgagaatattcattcctaggagttcttgaaagaactttcaggcctctgccaggctgcctctgaagcccccctggcttggtttcttgctttccaaggctggaggtcagagggaccaaggggtaggagtccgcctaggtggtatgcagtcttaatttagggacacattcttctaaaacaacagtaggtaaggatattgcaatgattcctcatggcagagagctagaaggaatttaaggattgatggtggaacattactacaacatctctagcctttttctgctggtctgactgtggttgcatttatgactgtgactctggttgtatttttgtgtgtatcccccttgactctgttacttttttttttttctcgtcctttcccctttgagtctctagggactatgtgccctagtttgtgggagtcagaagttaggtggggaggcaaatctgggagggtgtctgtgcacgcatgtgcac

SEQ ID NO: 14484 - DNA, 5372 bp, Human
  misc_feature (1)...(5372): n = A,T,C or G
cctgtctcagcctcccgagtagctgggactacaggcgcccgccaccgcgcccggctaattttttgtatttttagtagaggcggggtttcaccgtgctagccaggatggtctcgatctcctaacctcgtgatccacccgcctcggcctcccaaagtgctgggattacaggcgtgagccacggcgcccgggcaagaaaaaattattcaagggagtctctctcgagcctattctggctgcctataaaaaattaaaggccggacgcggtgtctcacgcctgtattctcagcactttgggagaccgaggcaggtggatcacgtgaggtctggagttcaagaccagcctggccaagatggtgaaaccccgtctctactaaaaatacaaaaattagtcgggagcagtggccggcgcctgtaatcccagctactcgggaggctgaggcaggagaattgcttgaactcgggcggcagaggttgctgtaagccaagattgcgccactgcactccagcgtgggcgacagacttaaactccatctcaaaaaaaaaaaaaaaaaggcagttttcatgtcaaagtctatgttattgaatataaggactctacctaggaagatggaagctgttgatgccagcactgcaaagagggtcaagagcaggatctggtaagagccagtgaaccgcttgaggatggcggaatcttcacagtgatctatacattggccataacaaaacaagataatagttaatagcaaccatgggcagatgctgcattttttaaatttaattttttttgagacagagttttactctcactctgtcccccaggctggagggcagtggtgcgatctcagctcactgcaacctccagcagatgctgcattttaaaacttatgactaaaaatagtaataagagtatctgccagaagtattcaaaannnnnnnnnnnnnnnnnnnntactaaaaaaacgaaaattagccgggcatggtgccgcatgcctgtaatcccagctactcgggaggctgaggcaggagaatcgcttgaacgcgggaggcggaggttgtggtgagccgagatggcgccatcacactacagcctgggcaacaagagcaaaactgtgtctaaaaaaaaaataaaaataaaaataaaaaaaaagaaggcatctttcacttatccccatcaccttccgtgtccatgcttgtcccttctcaagctaaactattcaatctctttttgtccattctctcacctctcattatctccttgagtcttccctatttcttttcactgaccaaaccatgtctcccctgtttatttatttatttaagacagagtcttgttctgtcacccaggctggagtggatctcggctcactgtacttccgcctcccaggttcatgcgattctcctgcctcagcctccagagtagctgggattacaggcacacgccaccacgcctggctaattttcgtatttttagtagagacggggtttcactatgttggccaggctggtcttgaactgctgacctcaggtgatccacccgccttggcctccctaagtgctgggattacaggcatgagccactgcgcccggcctaaactgttaaattaaaccaatagaaaaagagttaagaatataggtatttaaaaaataggacggaagtcctggatatggctccttctccctggtgttttcctcaacctttcctatttattaggctccaactgtcaaggtatggcacaaaattttaaaagtgtccatttatccctggatagtgatcaaacgctgacctcaaattagcaaggtaaccctctcaacatggtgacgcatatgtgtcacaactaacagttaaagaccttccgaaaatggcagctcccttgtctccccactgcggcggatcaaagtaagacgttccaaacatggtggcacaagatccttgcgtcatttcctgtagtgtgctctatataaggggcaggatttccgctttcgctcctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccggtgtgtgacagtgggggctattttcgaccatcccattttcgctgttggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaagacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgatttggggctttgagtttgatttttagaaatggaaacatttcttaggatttttcggtcttaacagtgacagggatcatctataatgtaaatttttagacaagaagtgttggatttggttgttttaactagatactaccaaaagctatgtattaatctcaaagcactactgtctaaagcggggataaatgggtgataaaagggcttaagttgataggaagtaaccagtgatacaaatgcgcaggtagctaagagttgagaaaaaagatgtagctttctgtgggtggatcatcatgcatctgcttttttgggagaggtgggcagaatacctgtactgatgacagctaatctctgaatctttttcctccaggatgttccttcaggaggaagcagcactaaaagcactctgagtcaagatgagtgggaaaccatctcaataaacacattttggataaatcctgtttattgtcttgtttaagtgttaggaagttcctgtctcaagtattctggggcaaccaggaagaggagaatattagagtcatttggggcacgtaagtggccaagtactttaaaagtccctttgggggcatttttaaccacctaggctcattggataaatttgttttttttttaaactgtgatactatctcaagtgttgtgtttggtgtttttttttttttttataagagagatggaatcttgctctgttgcccaggctggagtgcagtggcacaatcttgactcattgcaacctctgcctcccaggttcaagtgattctcctgcctcagcctcctgagtagctaggattacaggtgtgtaccaccatgcctggctaatttttgtatttttagtagagacggggtttcaccatgttggtcaggctggtctcaaactcctaacctggtgatccgcctgcctaagtgctgggattacaggcgtgagccaccgcgcccggccgacagttaactctttacaatacagtctgacataccagttttaagaaacagcttaggatgctttatttatagttctcagaagccttatctggaaacttaatgtagaagttgctgttaggcttcttgtcgaggactagaaatcttcattcccctgcagttaagagaaacttgtccaagcagaggttagtgccttatactccataaccaatgttgcagccgactttgggccaatggaggttgtagactcatgaagtgagggggagaacttgtggagttaaaaaaacctagaagaagagggaaaagttgagtgaattaaacgtgtgtatctgagcttttcaaagatgaggacagaggcttttttacctggctgtggtgttcctagagttggtacatacacaactggaactgtttgtatcttgtttaggaaggcattgtatgctggaaaaaggacaggaaatgtcacaaggcatatctgaggaaggccttaaaaggcaaagtcaactctagaatgagaatattgctaaaaataattcttaaaaataagtaatagtaatggcactattacaggaagtttttatcccaatttaacccattttagagttactttcagcttttggctgaaagggggaaaatggccgggcacggtggctcacgcctgtaatcgcagcattttgggaggctgaggtgggcggatcacgaggtcaggagattgagaccatcctggctaacacagtgaaaccccgtctctactaaaaatataaaaaattagctgggcgtgttggcgggtgcctgtagtcccagctactcaggaggctgaggcaggagaatggtgtgaacctgggaggcggagcttgtagtgagctgagatcgtgccactgcactccagcctgggcgatagagccagactctgtctcagaaaaaaaaaaaaaagtggggaaatggagtagacaatagtgttgtgttaatttttttttttttaggctgtgtgtggtggctcacgcctgtaatcccagcactttgggaggcctaggtgggcagaccacctgaggtcaggcattcaagaccagcctggccaacatgccactaaaaataaaaaattagacaggtgtggtggcgggtgtctgtaattccagctactcgagaggctgaggcaggagaatcgcttgaaactgggcgatggaggttgcagtgagccaagattgcaccacttcacaccagcctgggtgacaatgggactccatctcaaaaaaatttttttttagacacacagtatcactggagtacagtggcacaatcatggcttactgccaccttgaattccctgtctcaagcaatcctgcctcagcttccctagtagctgggactagatgtgtgccaccaccacacccagctaattttaaagtttttttgtagagatggagtctctgtgttgcccaggctggtcttaaattcctagactcaagccatcctcccactttggcctcccaaagtgctagg

SEQ ID NO: 14485 - DNA, 44249 bp, Human
acatagagacagtgtttctgtatgagcatgtgtttgctttgtttgtttgtttgtttttattggcgtagttaattaaagatcatatacccaggaaggtggtatggaaggagcagccagatctaattttctttatacccttcaccgtgcctagcatagtgcataggtgcattcaatgaatatttgagtaaatgaatgtaagaaatatacagaccattggctgagtgtggtggctcacacctgtaatcccagaactttaagaggccaaggcgggtgcatcacttgaggtcaggaatttgagacaagcctggccaacatggtgaaaccctgtctctaccaaaaatacaaaaaattagccaggcgtggtggcgggtgcctgtaatcccaactactcgggaggctgaggcaggagaatcgcttgaacctgggaggcagaggttgcagtgagcagagattgcgccactgcactccagcctgggcgacagagtgagacttcatctcaaaaaatatacatatatatatacagagagaggccattaaagcaggcttttaagccagaaattactgtcttcccaatgattaataagtatttttaaggcttcattagtgacaaatatgttacatgtataaacagatgggcaggacttaaaagagtaggccagatagttgatactatatctaaacttttctgggtgcctcttagcaaataaatggatctctctctgttccttgttttacttcccctttccccgaggaaaatcacatttttcaggtctgacaacaattttcaacctgataacaattgctccggtttcattttggcaactgctaaaatggtcaccttgggaaccccaggcacacacgctgactgtacttgcacagcttctacactgagccttttggaaattgcctccaggaagcctgtctctcatctcacaaacagaaccactgatccaacctgggccaccatctttctgcatctgctctgtctgagactctcccagtcagctcctaaggagacagggaatcctgcatcactcatcgcttaggctagactgaaggtctccttccaaaggcaactacttactactctctgccttgggtcatacaataagcactactcttatctattcacacgctaagctacttttttaaagccagctttgctagctagccacctcgaaattccccagaaggaatcaaacagaaatggaacaaaggacaggaaaagccaaggaggtttgctgaaattgaagcattctgaagacagctgggtggtaaaatggatgtgacgtgaggaaggtggtcttgggtgcacccacagaccaacactgccattgttacaatttgtgtaggatgatctcaggtgacagacagcagcaatttatcacacccagaaacgcatcccccacacatatttacttgagggtaccagacctgctcacaaagcagagaagagctaaggcggttctctaagggcagagaattgctgctattgcctagtgagtggggagagggtactcctcaggccttacttcctatcaaatcatgtgtcagtgttgcctaggagacagaggcacagtaactactgtagccaaacaaggcacataaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgctctgccgctgcttctcatcgcatggccaccgcatttctcagtaagtgggaatcaaatgcttcactcaccacagagtaagcaaataaatatcttttttctatgacatgggctgtaacaataccctgtgctccacctcctaataatttcactacacccagggtggggaggagggttaggaaaagcaagaaacaatgacttctaaatatatgacaaacttgtaaacaacaaaaaggggaaacaaaactccttataattctattattattagcagggacagaactaataatggtcccattaaacttgcatcattaggcaggtcatgttgattctgggtataaccttctattcttgtgttttggctcagtaagtgagatgtgcaaatccgtggcaaggtgagtcatatgaaaacaacacctatggttttgttagtgcttacatcaatataagacatctgttttccaccgctccagataattatgcaattaaaatgagaacatatattctgccaagatttcttagaaaataaatgagcttccaaaatagggtatagggtttaataaaatatctcaggaagtttcagagttaagcaagaaatctacaaataaagaaacaacaacaaaaagtagagagaggcactttatctaactgaaggaggcgttctgctttttctttctggtaggggttcttggatttccaagattgtttcattgtatataaaatgtacccaaatttgctgaaatatgtcacttggttttgtgttcactaatgtatttacctaaagcaaggtaagcatatttccatgtagacagaaaaaaggatgaaatggaaccaaaaaaaagggggaaaaaggagagacagagcgagaatattttaatacccttgagcctaaaattaataaacacatgaaaagtgatggtgcttttatagccatgtgaataatgtacttagtacttgctttaatgaattaccatactgaacattttattacctggcatgatttctattttaagtgaatatgtcctctttcatggttatcgaaaaaggaatttatgtagctatttgttagaagtttgcatttcaaagcaaaataaagttttagaagttaaatcacctcatttgtttatattatttgaaacactgcatgggaaacttttaggcaaaataccaaaagtgggccaggcttgttacacactccccagcctgctgctctcctgacctaactcattcctctgttaggtttcaccgcacattgcacattagggctgtgcactaatttgcttctattccacacagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggtacgcccaggagcatggatgtgagatgacaaattgcaccatgtgcaattggcaggaaatattttgctactgggatatttgtagcaaactctttcttctatttttccaaatactcaaggtggcaacaccatttccacttggactgacagagagttttatgtttacagccacaacctgaactcatgagttctattttaggactatttcagaaatttaatcaaaagtacagtagtagtaaaaaaaaattgcatgcatgataagtggtccttattattcatttatatatttaggaatgtgcagtttttcattggggggtaatgcaatatacctaggtaaacatgtcttttgcagtttataccttggtttattcttcatcccccaagagataacttttattgctgattatactgtacaggataaaagagaaagtaaactcttcatatttaaaagcctaccagagcatgaatcctctcagttgctttacaatttctgccactaaggttgagtctggaattaggtgttaccacagttgactcaaaaaggttttaaaaacaggggtgccagtataactttggttataaaacgaacgccccaggcagaaaaataagttgggaaaaaaaagaggggaaaatatttgtaagtctgaacttcagtagaatttgaccagttctcaagaacgctggggaaatccactgctaattgtcaaaattttaccaaacttcctagaaacacctatagggaaggagactgtggttgttttctccaaaatttcaaaaaatgtaacacctatcagaaactagatttttagagagcacttgaggaattttagattgactcaatgaaatgttatatgagcaagtagatcatgagatcatgatttctcttaaagattgagcatgtcttcctggtgatagataaacaacctatagttgcttcattctgcttagtttgcatcttattttaacaatttaatggttttctgctagattttaattggtagccatgagaagaatgagtcgaacatattgtcgatatatatgtttaagctaatgaagtcgctctattcttttatagtgaaatatgacccagttgacatctacataacagtgtatctttggattaaagaaatggcctgaagagatttgttgttgttgttgttgttgttgttgttttaagcagggacaagaagtattaaggggccacagagagtgagcagaattgtagaaaacatggtatcaaatcctgaagctctagtactattcaaccttatgtaaaatttatctgactcacaaaaaaaaaaaaaatgtcattctttttaatatttagacccctactgagtaccttgtgctgcctataggacaactgattttgttcaaaagcacctctttttaaatatgacaatgagacatgaaaaagctgtctatttatttatggccaaaaactaataatcaaaaattttttgaatgattaaatttgaaaaacaattctatttttagcagctataaaatcagaatacatgacaaattctaggggagagtgcttgctcatataaaatattcaattatctctccactgagatattcaacagttttatcatttacttcaacaatttaattgcaaaggataaatacatgtttattgcttttacaagtacatttataacatagttttactttgccagtcagtgaaagtcacaaagaaatattaattttgcagttttttctgacctagaattcctattattgaaaattagtgcaaaatcagagcatatttaatattgtttcaggaaatgctgacattttaagaaatcaccttcataacttaaagaggaagctatctttgttgctgttcttaaggaatttttatctttgcttctcaggcttagtagattactagtgttttcccttaattcattaaaattctcacttgttgaaaattttaaaaaaattatagagtacctgcttttgttgtcatcgtcatcgtttcattttttttttaatttctacatggtgtgaaatcctcagagaaaaataaacaggattttaaaatcaaaactggcatacttctgattaacagtacttaagcttatttgacaaggaattgagtgatttatatgccgatcctttcctgctgttttggcattttaccaatttcattagtaagttcagcagtaattgtagcaacttaagtaataatttaagaagtaataatgaagttaagagtgttctgtgctatttcctggaggtattcatttagcccaggtctctcctgtggttctactggaattatatttggaaaataccaagccacttaaataaatgttttaaatgaaattataaatcattgtaattagtaccataaagttgacagagcataggttttgccattggaagatcagagattgggtctaggctccattacttaacagctgtttgatctttggcagattatttcagctttcagactcctttccttcatgggtaggaataacgtccatggaagggatttccatcatgtataacagccacatgtgtctggtaccaaatctctggggggagcacgtggtaagagagtaggaagaactcctttgtaaaagtgaggacaacacagggggaagccatgcgtgttatttgcccttgaaagttaagttcttatgaaatatgcctttcaaaatgtgcagaagaaaaactcaagacttctcatctacagttcccagaaagagatcaccgactctcctctttgacatgtagaacaggatgccgagacttttgtgtgtgttcacactgggttatcacatttccagctctagattccttctcattgcccaattgtttcaaggacatagaaatactgtctttattttccccaggtctatcactgtgtttttcaattcttttgtgatccgctccctttgcggggtgggggggggaacaaaacaaatcaacaaacaaacaaaaaaaacactcttcaaagtaccacaagttgattctggattggtgatacaaagtttctcttaggctacagattgttttagattgaagtttcctgtcatgttcactcatctttaaatcctcatagtgaaaaaggtaatgttgtttatttcttttgctgactatgctagaaattctgctattcaaagatctgctctggtttcttgtcgaaaagcaatcccttcctatttgtttccttctcttccagctttgcacataccttgggttccaccaggcatgtctcttccctgttgtgtgcgtcaaggactctagttcaccctttagatggcaaatcagaagtctctgctcctattgtaccccatacacacctttactgaggcagtttttcaactggtttacatttatcaatttatatttcattctgtccttcaaactatgaatctacattggaagggcaaagtccaacatttggtcatgtttgtactttttgcgcataacaaatatgccataaatgtctgttaaatggccaaacgactgcattttatgttagaaagcagctatcagtttttcttaaaaatagcaacaagatgattttggtatctcccttgttttctgtaggatatgatcatcgtggcgcatgtattactcatccttttgggggccactgagatactgcaagctgacttacttcctgatgaaaagagtaaggaccttctattcaattcaataatgtttatttttaaaaatatgttagtaaaaggataacattatttcctcttaaactgtcgattagaacattatatatggatttttatgagacaatatttatccccatcagaagacagatgctttaaacatgccatattttaagaaagcaatgttggctgaaatgcaaatgttatgctacagtgggaaatcaaagtcaaagtgtgggtgtccgggcaccatggaataaagctggcgccagtggtcgcatttggaatgtcttctcacacaagggagtagttagaaggccccatgaccaaacgttaagaaacttccactgcattttgtcctgaaatctgctgatgttatgtatttgatgtgatgacagagtttaaggaaaatcatcacatggtcccagtctagcattgtcaacagaactatctatggtaatgacaatgttgtatctctctaatgtccaatgcagtagccactagccatatgtgactattgcgcccttgaaatatggatagtgcaactaaggtaatgaatttaaattaatttaggccgtatgcagtggctcacacctgtaatcccagcactttgggaggccggggcaggtggatcacttgaagtcagaagtttgagacccacctggctaacatggtgaaaccccaactctactaaaaattcaaaaatagccaggtgtggtggcacatgcctgtaatctcagctacttgggaagttgaagcaggagaatagcttgagctgagaggcagaggttgcaataagctgagatcgcacaacactgccctccagcctgggcaacagagtgagactctgtctcaaaaattaattgattaattaaataaaatttcaatagccacaagttgccagtggctaccgtaatggacaatgcaatatagacagagctctaaaagtcctcatgtggtaaacatggatgtagaggtgtggaagtccgttaaggtcaatggataaatcctgataacttagtaaatgaataaaagaaggttttgtagttgtgtgtacaataccgtcctaattgtggtaaaaaaaattaaaaattgcataaatatacgcccagaaaaaacataacgaatatatcatatgttaattccattcttagtggtacaattattttaaaaaatttattttcttctttttgcttatctgtgttttccaaaatttcttcaataaacagatattgattttgtaattaaacaaaagctttaattttgaaagcaaagtcagagaatggctcatgcagggggaagaaaccttttctttctgtaaagccctatttaagtaagtttgcttgcaaatatttttgtctgtgactcataataagaggtaaatacatttttacattatgtaccagcacacatacaaatatataactacctttatgtagtggaaacgagattcatgaaacagctcttattatgtttgatgcacactgatattttctattctatttttcttccacattactaaaacaaaaattctggtcacaaaccaatacattgttattattgcctgttaatggataatgactctcagtttgaaaattatggttatagtgaatagtgatatagtaacatgttcatatttcaataaaaatataggtattataggtaaacacctggacatgggcaacgtaaaaaagatattaaaaacagttttgaagaaacctcttctaggacaggcgtggtggctcatgcctgtaatcctagcactttgggaggctgaggcggacagatcatttgaagttaggagttcaagaccagcctagccaacatggtgaaaccctgtctctattaaaaataccaaaaaacccacattagcccagcatggtggcatgcgcctgtagtcccagctactcgggtagaaatagccactttctctttgccccggtgttacaggcacgcaggagcaactgtgtctgtggtgctggcaggtccaggacagcatctgcagggcaataaatattcgaaaagttttaaaagtgctgcctatgtccagttgaacattgtgttgtttctttatcctttgaatcaacagtttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgacgtaagtgtttattctaatggatatccttattgagaataaatatgcattttgactgcattttctttatcaaataaaattttggattaaaaaaataaaattactgacaggctctttgttatgttaccagtagaatagtgtctctctaagaatgcctgtgagctagcgccgggtgtattgttcagcgttaaacagcatcacagaatattttaacttttggatgattctttcccttaaggaagaatgtttagtaactttttaggcaccatggattgggtactggttttctgtttcccataaaattaccaacagaacaggagacagtagcctagtaaaacaagaagtgagcaggcagagtggagagtcagggaaactaagttcaaaacccagttcttccacttcctgcctttgcaacctgggacaagtcatttagcttctcagagcctcagttttacctcggggctacattcaggcacctgctacatattaggtgtgcaataaagtcaaacaaagggagaagtgattcatattcactatttttcagtcaatatggaattctagagaattttctgtccgacattgacctctggggagatggtgctcaaagggaacttgagtttaactgtaatatttcgcttgtatttacaagaataatgcgttcatgtgtcattgagaaattactatgttgttattacaatggttttgttttgactttttttctagcaaaactatttcattgcatcttactaatcatttaaaaagtagaagaaaatgcatatttgattaaaatagctctcttaagtctagttctcttttatgtatcatgacttgtgggttttatttttagtatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccaggtaaagcaggcctccaaaagtccagtttgtatgttttggactttgcaaatatggaaaagtagaaaaattaacactaacccacttttctttagtcagtcacccgttcttgtcaagtactctcccatatcaacaacatcctaaccaaggctgctgccacttcttatcataaccaactgaattccatctggcacattcttgcagaaatatccacagtctctgcattggcctccagtggaaagttggtgtttctgatacttagagtcagtaatacttctgatcaaacacttaagtgcacacacaacaggggagagaaaagaggagaagcaggctaccaagtcctgggacatgtgggtgcacccaataaccattgtcttggtcagttgagctcacgggtaattttcaaacgactattttgtcatatcaccagctgaagagaccatacctcctgaattgtgtcagtgacttaaaacagaagcataaagatcttctcatttactttttttttttttgagatagaatctccttctgttgcccaggctgaagtgcagtggtgtgttcttgactcactgcaacctctgcctcctgggttcaagcggttctcatgtcacagcctcccgagtagctgggattataggcatgcgcctccatgctggactaatttttgtattattattattattattattattattattattattattattgagatggggttttgccatgttggccaggctggtctcgatctcctggcctccagccatccacccgcctcggcctcccaaagtgctggggttacagacatgagccaccgtgtccggccccatttacttgttataacttgtctagaccacataccagccaatttgcatgggcttgatcccaagtacagagactaatccaaggtagatacaggaacacagagatgggttattgtatgtggcttacgtcaaaccaccattcctcctttctataatgaacaactggattttacctatgaggcactttgcagcttacatttctacaattctaattatcctctgaacactctgatacaggatgacactaataaaaattatttctgttttgaaccaagtggaattcacttaaatgattctttggatgagaactataagacaaagagttgtcaggatctctaaagtgtacttgggtgtggactttctggtcatttaatgcatggacaaatatatattaggttggtgcaaaagtaatgaccaaaatcacaattacttttacatcaacctaatatatgcatatatacatgaactgaataagtcaatttgctttgaggtagttcttctttttgtctgtgcaaaagcacagatatgaagaagaaatccatctttaacttctctacaggtaataagaggctctctctcatcatcttctccctctgcttcttgaaagacactggctgacagtgataaaaatgatctacagctcacttaagctacgatcaaaagacccccttctatctctcaaggctcccacttgaatgcggtccttcctggcccaggtgcaagagcttgtttccttctctgagcaaccaccaacaaggccagtgtttcccacagtgtattttaaagaccaacagttaatacagcaacgagaggttgaaatgaaaacaagcctttctagtcacataatttgagaaatccttaatgaagcaaacataaaaaggttgcatttaaaatcttggccgggtgcggtcgctcacgcctgtaatcccagcactttgggaggccgaggcgggtagatcacttgaggttaagtgttcgagaccagcctggccaacatggtgaaaccccgtctctactaaatatacaaaaattagctgagtgtggtggcacgtgcctgtaatcccagttactcgggaggctgaggcaggagaactgcttgaacccgggagggtgaggttgcagtgagctgagatcatgccactgcactctagcctgggtgacagaatgactctgtttccaaataataataataataataataataataataataaataaaataaaatctgaaggttttgttttttgagacagggtctcactctgttgcccaggctggagtgtagtggtatgatcttggttcattgcagcctcgacctccccagctcaagtgatcctcccacctcaacctcccgagtagctggaactataggcacatgccgccacacctggctaatttttgtattttttgtagagttggggttttgccatgttgcccagtcttgtttcaaactcctgagctcaaacaatctgcccgcctcagcctcccaaagtgctgggactacaggtgcatgccaccacacctaatttttatattttttgcaaagacgaggtttcaccatgttgcctgggctggtctcaaactcctgggctcaagagatatccacccgccttggcctcccagagcactgggattacaggcatgagcaccgtgcctggccaattcaaggttttcttcaagtcctagtatattaaagaggactttaacatgctaatgtgcatcaagtctgcaaagtctgcaatcttgcagtgttgtcaaaactcatttcttctgagcagcaacctatgtaattcatgaagaatttggatacaacctaatgaatcacacaattctaggatggaaagggatacgcaagaccttcctgtaccaacccgctcctttacagttgaaaacacagagcccagaagagtgggggtcaatgtctcacagctagttattaacaaatgtggcattagagcaccaaagttgccggacatcaacctcaaaatgacaatatattgtacttctcttgaacttccacacatgtattgcacaaacaccacccccaggccccaaacaaaatagctgggaagctctcgaatatcagaaatggggactttataattctaattccatatctccagtaagttggccttttgtagttagtaggtttctagaaatatgtgatcatggccgggcatggtggctcatgcctgtaattccagcactttaggaggctgtgggtggatcacttgaggtcaggagttcaagaccagcctggccatcatggtgaaacgccagctctactgaaaatacaaaaattagccaggtgtggtggtacacacctgtcatctcagctacttgggaggctgaggcacgagaatcgctccaagccaggaggcagaggttgcagtgagccaagatcgcaacactgcactgcagcctgggtgacagagtgaggctctgtctcaagggaaaaaaaaatgtgaagatgattattttttggtgatgaatacgacgttcacatcactatagttccaaaagaagcatgaaattcagagtttgccatggcaatgttttgtcctttttacttttgactacctagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggttagtactgtacctatttttacttaggcaaatggttgtttcctgcaacctcataacactcgtaaatgttccaatttaggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattggtaagaccgacttaacccaaagctgaaataactgaatctcggaatctcagcactggaaggaagggttataaagatcacctagttttactgcttctctgatgccaagtaagcatcagacccatgtttgaaaaccactggggcaaggttctccattccaacaccaccagtgatttttgctggacaactctgtgttatggagggctgtgctgggcactgtaggatatttagcggcatctctggcctctacacactagatgccagtagtatgcccctctgtccttgagctgtgacttttaaaaaagtctcagactttgccaaatgcccctcaaggggtaaaatttcccccagttgagaatcactgcaccagaaaaagtgaatttagctgcttaaaagagaccatttaatccttcatgagttctgacaggttttgtgaaatttctgcccctgggtcctgtgatggactagtgccaccccaggtgatttgagtcccttccctgtagaatagcctctcttagctgttcacaggcagcacgtttcccatccagaagcccttcttctcccaggctaacatctctctctctctgaatttctcactgttctggcccatctcctggatgttctgcagctcgaatatctctcagtgtgcaattctcagctctaaaaattctattcgtggttttgtctgctcagttctcaatagagaagacactctccctcatcccagatagttctattagtgaaactcatcaggcgctctcacatggcattcttagttatggagattccagatttcaatggtgggtggttattatgggctgtggggccagactgcctggatttggatcctggctccaccactggctgagtgaccttggacaagctgatcattcctttgtgcctaatcttcttatctgaaacaatggagaggaatcaatacttcctgtgcagtcttcgtgagaattgtgttactaatgataaagcacttagaacagtgcctggcataaaggtttaataaatacactacaatattatttagaaggtatgatttggctgtgacatatctatatccaatggaatataactttgtgtaaagaatcatagcccttactaaagaggttatgcaattctctccagtagtatatttcttaggtgaactaaaaatgtcactttcatgaaaataggcaataaaagatgccgaggaagacctaggaaacaatgatattaatatgaaaatggatatgatctagtacagaccacaggaattcatttttcttttatgattttcattttattgaggctgattcctaggattactaaaataaataagtactttcttggttaagaattttcttcatagggtataggaggctctgaagccagtggatcccactcctagcttttccctattaattgtgagatctaagtcatattacctaagacaaggacactcattaagaattcatttcccctcacctcaccggaccataagacaatcaagtgagatctcaagggaaaggacattagagtcctaagtaaagacaaatttagcccaatccactcttcttcttcttcttcttcttctttttttttttttgagacagatttcttgctctgtcacccaggttggagtgcagtggcgcgatctcggctcactgcaagctccgcctgctgggttcacgccattctcctgcctcagcctcctgagtagctgggactacaggcgcccaccaccacgctcagctaattttttgtatttttagtagagagggggtttcaccacgttagccaggatggtttcgatctcctgacctcgtgatccacccgcctcggcctcccaaagtgctgggattacaggcgtgagcccccacgccctgccccaatccattctttttgatgcaaaagaaaactgaagcttcctgctccagcccccaaacaaacaaaaaccaaaagacgcagtaaacaaaatgaaattaaaattaaaaactgaatctcagaaaggggaagtgatttgttcagggccacatacctactgggaagaggcaaggcttggtggaaggtccagggaaatgttctctcagtggtcaggtttattctgggcctggtacaacttgagtagtaaagggggatggtgggtgagtcttgcaatgagctgagggggggaagtaattcaagcattcaactctatttggagtagtaatccttgtagtttccagaaagggtctcttcttcttcagcactataagacaagagtattatgggaggccaccggcttcctgtggcttggagatcagttgattaagacctgatggtaaatatttgaaaaaagcgtatcttagaaatgccttgagaagtgtgggtggattggaattatcagctttgatcactgattctaaaaaaaaaaatcactgatctttcgttccctaacttagatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcaggtaattactcagattattccaatatttgataacagacatttgttttagaaacatttaaaaaattatcttcagtgactgcaaccaagttacagcttggtactaacaaggtcaaagttaacttaatctacccaggtattatagatataaccaaatagatataaaccaaatcttactggccttttgttttgaaagaacatacttttggttgaaactaatacaaaggattagatacagactcattggtactagtgctggttaaaatctaaaatgatagacgggtgcggtgactcacgcctgtaatcctagcactttgggaggccaatgtgggtggatcacctgagaccaggagttcaagaccagcctggccaacatggtgaaaccccatctctactaaaaatacaaaaatcagccaacgtgatggcgcgtgactataatcccagctactcgggggcaggggctgaggcaggagaatcacttcaaccagggaggcggaggttgcagtaagctgagatggcgccactgcactccagcctgggtgacagagcaacatttcatctaaaaaaacaaaaacaaaaaaacaaaaaactaaaataatgcagctactataaaaacgatatgatgaattctcaaaaaattagaaatagaattcccatacgatccaacaattccactgctgattacatatacaaaagaatcgaaagcaaggattcaaagagatgtttgtacacccatgtccatagcagcattattcacaatagccaaaagctggaagcaacccaagtgcccattaaatgaatggataagcaaaatgcagcatatacatataataggatattatccagcattaaaaggaaggagattctgacacatgctaccacatggaggagccttgaggacattatgctaagcaaaataagtcagtcacgaaaggacaaatactgtctgattctacttttatgaggttaaatagtcaaactcatagaaacagggtaggatggtggttaccaggaattggtaggagggtggaaggagaggtattgtttaatgggtacagagttccagttttgcaagattaaaagagtgttgaacattggtgacacaacaatgtgaaactatttaatatcacaaagctgtacacttaaaaaggattaagatggtaaatttcattatatgtattttacaattaaaaaaactcattagcactaatagacaaaaatttcaaggggaaaggaactgagaagaaagccaatcaacatttcttgagcatcaattatgtgtcaagctttattatgtgtttattccatcctcacataattctatgatgtaattaccattcccattttataggaaagtgaggcaaaagagatgaagtaactctcccacagtcacaaagctaggaaaaaaaataggattccaacttatgtcttacagagagtagacaaagccaattcaattagattcaacaaatatttacaaattggcttctttgtgagaaataagactgtttctgccatggagtgacccaatcttgtgacatacttgcccagccttggggttgccctcccacaggaaaagccagtacagctagagatgggggtgtgggcacagagcctgctctgcagagaggaattgaacggaatctgtaaggatgaagagaaactagtctggtgagaaaacatgagaaggactttcttagccagagcttcccaaaatacttacactgaaggactgtgtgtgcacgtgtgtgtgcgtgtgtttttataatgtctaatctaccatagattggtgcttttgtcaaatacaataaaaatgatctgctagaaaaaattaaatatagccaaagacatgtaaagtgtcagttcactgatcatgtgtttggatatcatggcaatgtcaaattgctatcaaaacttccaaattgcagtcataattttatctgtatttagcccatcacaagccagtaataaatagttcctgacttgcaccagcctaggaaaaggagtaactttatgcttgagagagtatggttctttcagtcaagtggcaagtaattcagtctgcctggatgcctggacataagaccaatgctgaaatcatgactctgtatctgacattgtgatttctcccagagtggctctataagattttgctaaaaaataaagaagtggcttcttttttaaaaaccatgactctgggcaatggatgccactgaagagttttacacaatagagaaatatgtctacatttgcagagtaaaagaagatttttggtagcagcatgaaaactggatgtgagtggggaggggcgacatggacatatgatatcagttagcggctactgcaaaggtccaagcaaaagataataagagctaaaataggcaatggtcacagggctggagtaaaaaagggagaaacacctccgggggtattcaagatacaggtgtcaggagcacatctctggtacaggggactagctggatggtggcgaccatgatcagtagaaggaaaaagaagaagggctcattcatgagaaaatagcttcatttcaacactagacaatctagcgttcatgtgacattatttagtaatgtgactatagattatggagagacaaggtgagggaataatgcattctagcataggccactccagtctttcagtctggaaacatcagctgggcctggataggaacacctggatcttgaccgttgatcatttcgtatattttggttacaagatagcgttccactgaagggtgactgccaacacatccacactaacgcacctagcataaacgaattaatgtgtgccctgttgattttaaaggacttgctgaacagtgagtcacatgacctatataggacctcccattctgataatcggcagaactaaattaggtgtctagagattcttctaatgctatctttccccacttagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttctgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgttggtaatccagatcttactgatttcatcaattttatatgtcctcatttgtttgtttgtttttttgtttctttttggacagagtcttgctctgtcgccctggctggagtgcagtggcgccatctcagcttactgcaacctctgcctcctgggttcgagcgattctcctgtctcagcctcccgtgtagctgggactgcaggcacatgccaccacgcctggctaatttttgtatttttagtagagacagggtttcaccacgttggtcaggctggtctcgaactcctgacttcaggtgatccaccggcctcagcctcccaaagtgctgggattacaggcatgagccgctgtgccgagccatatgtcctcatttgtatgtgtctgtttggttctatgcaattttagcacatgtttaagttcatgtacccatcaccacagtcaagatacagagcagttgcatcatcacttgttacacttttataaatacacccatctctctctcctctcttctatccctgaactctggcaacgagtagtctgttctccatctcttcgattttcccatacctaattttgactttatacttttttaaaaaaagaagattccaaaactgtgtaatctatagggtcccacaaaatctggatctgtccctgagccttcagcctagcagatatagagtataaagaggtccatgcatcaccgggactcctgtgttagctctgcaactgtttatgttacgatcaaatggactagtttgcttggcaagtaagatgggcatcgtctctgtcagtgagatccatgaaggataataatatacccaatggcagctatggatgaaggggcacatttccagtcttaccctgacacagatgtcaattccacacccaggacatgtggtattgcaccttgaagatagaaaattcataccctgtgttggccgggcgtggtggctcactcctgtaatcccagcactttgggaggccgagatgggcagatcacgaggtcaggagatcgagaccatcctcggtaacatggtgaaaccctgtctctactaaaaaatacaacaacaaaaaattagccgggcgtggtggcgggcgcctgtagtcccagctactcgggaggctgaggcaggagaatggcgtgaacccgggaggcggagcttgcagtgagccgagatcgcaccactgcactccagcccgggcaatagagtgagactccatctcaaaaaaaaaaaaaagaaagaaaagaaaaaaaaaaaaaagaaaattcaaaccctgtgtttgctattatccaggtgtttccggcaagtcaacataggcattgtatgagagaaggaaacagttaaaaagcaactagtgcgtctcatgtgtatgataaaccattcagcctggggaggcacacacacgtcgttaactgttgcactaggtctataagagcatgggatggtgggaagaagactggagccttacatagaaagcccaggtttaacattcagcctttacaaggattgattgtgtatccccagacaaataatttctctctgtttcctagggttctcaagataaaggagataacatccagctttcctgccccacaccgtatctgaaataaaaacaacagcagggatagcagattacatgtgttttttaatttttatttattttgccaagcactatgctaaatacataatcttagtcctatcaaaaaacttgtttggaaagtttaggtaattggcttaactctgttctgcatggccaacaagtggcagggatggggctctaaccccagattaactgactctagcacttgatctctggacactctggcatggtgggacaggattctgcaagctttaaagtgctgggtagattaaagtcttatttaagagatcttggggatgggtgcggtggctcacaccagtaatcccagcactttgggaggccgaggtgggcagatcaggagatcgacaccatcctggctaacatggtgaaacttgtctctactaaaaatacaaaaaattagctgggcgtggtggtgcgcgcctgtagtcccagctactcgggaggcaggagaatcacttgaacccaggaggcagaggttgcagtgagccaagattgcgccactgtactccagcctgggcgacatctcaaaaaaaaaaaaagacatcttggtagccaacctttgtgattatgggtgatcaagcatgtggatgccatctctcatgaatcctatgaggtattcatcaaccattggaagagtatacataggagagatttagttcaggcacatgccaaaatgttctactatttaattcattcgcttaagctatggggtaggtcttcaggaaagtctcgggcagtgacccatcagcccatgtgaaaatgactccgatctgacacacagcaggtagatttccactgaagactgggaaagataaggaaaggcctaataaatggagaactgttctgaatctgccagggggctggtcgtgctaagttaccgagttcccaagggagaatagcgtcccctaaagttgtgcaacacacaaccagctcagccttacaggggtagccctcacatcactcagagagacttacaggagcatcatgagccttcctggggagagggaactgaaaggacactaaaaggaagtgagaatgggctaaactcacctgcttcataattctgttgagaccaatcttcccctccctcccctcctccctaggttgatgcccccacctaactaaactgacccagcacacacaggactttcctcgacatggctccatttgcaccaggaaaattcactctgttccccaggagggaaacaaatacgagaagcattaatcagtctcagggaatttttaacaaggtcattaattttgtcaaatgcctaaggtggaagtttaatttttgttacttgaattcaatagacttctttttaaaaatgctttatgttactccccaggggcacaaaactcactggctcaaaactattgctatttctaagtgtcttcccaacacctctctctatatgtattcaattttggagattttaaaatgctgtctaaggaaacttaaaccaagatgatggataccaaggtcagaatcctagataagaagttagttatgctttctgagtctttgacttttgaagtcatagtcaatgttgactgtagagaatttagaacgtattaggtgaaaaagaagcactagatattcaggacatctaggtttttagctacggctctgccaacatctagctctatgttataagctagagatgacaaaaggtaatgttttgtgagcaaagtaatcagagactgcttagagtgcagcattgaggattctgaggctaaatttagattgtcagaaggaatcgtgatctcctgccaccactgcaagggacagagtggtgacgagcatgacagggtttttccaccctggcctagtcagtctacacctaacctctctgggcttagcatcctcacctgtaaaatataagtgctgcactacaaacctgcttccacctctgccattcacattcacctcctctgcaccaccccactgcaaaagtgctgagagtgaaattgtgatccataacgagcgcttattttaagcttgtttttaatttattattcactctccactttagagctctcttaccattattatttcctaaataacaccttcctagtttgaatctgggctcattatagttttcccccaggtgtacctcgttgccattatctatagcaaatcccatttcatttactgccatccttttcatgaagatgagctgattaatattactactcaccttataaatccatcctttctggaatttactcctctgctcagtttaggatcattagtgaatttaatcaatgtagactttccattttcatcaagatgattaataaacgtaataggaagtccaagcccctctgggacattttgcatggctcttttttatcccttgaggatgcagcaataattatactcagctaggagtccatcaggcgattttgctgctacattcatttcctttaactatgctttctcctcttttgccttatcttaaaaacagcatgctgcagccctcccactccattttactccaagactcaactcaaatatcaaccctttcatagttattaatttcccccccccattattttaatgtaagaaaatggaggtcctgagatactaaatgactcagcagttgtcaaacagccaagaagtggctattaatatacaattttctcaaatagatgacatatgagccaatcagtgaattagaatagatttgattaactaattaacccattatagcccaaggttatttaatttaaaaaatgagacacagagtaagttttgattgatgagataaggtgagctgggagaggctgggggtgctgtccagctctgttggtaaggtccctggccagccaaggagcacaggggacagcagggagggggtatagttagcaagtgagtgctctttgcttgctctgaacagtgcctgattggctctcctgtcctagaatttccagagcatggaattttttaaattaaaaacaattgttttatttcagcagctttaggggtacaagtggtttttggttacatggatgaattgcatagtggttaagtctgggcttttattgtacccatcagctaaatagtttacatcatactgaataggtgacttttcatcccccatgctcctcccaccctctccccttctgcgtcttcaatgttcattataccactctgtatgcctctgtgtacccaaagcttagctcccatttataagtgagaacatatggtatttggttttttgttcctgattactttccttagggtaatggcctccaattccatccaagttgctgcaaaagacattattgcattctttttgtacagctgagtagtatttcattgtgtatgtttaccacattttctttatccactcatcggttgataggtacttaggtggattccatatctttgcaattgtgaatggtgctgtgataaacatgcacgttaggtgtctttttgatatagtgacttctcctttggaagatttctcaaaaaactaaatgaggcctacaatttgattcagaatttttttttaagagatgaggggtctcactatgttgcccaggctggtctcgaactcctgggctcaggcaatcctcctgccttagcctcctgagtagctgggactatagctgggctgggatttttttttttatggaagtagcagtttcattttatcagtactcgttatcaactgccctagatcagctggcttctctgtcttatcttaagagctaacttcccaatttttacatgtctttctcctttttaaactttcttaacttccggattcttctgttcctttgttatctttgctgtctcctgtttatcgaaaccttttgtttcctgaccctggtcttcatgaagctgtgtgttttctcaagtccatcatcttctcttcttcccgccatccttgaagctcaaatgccaagtgtgaaacgaggaatgatgaaaataaatttttccatagtcatatccttgcttgaggaaaagagacttatgtgggtctaccctgcacttatttctggccgtgtctttggtcaggatcagtggttctgagaactgcttcttctgtgacagactacaatcactgcaattgcccttcaaagaaacgatggagttttgctttgacctcactgaaagcaaaatttgatggccaaaatttgactttcgttagtcttgagatgtatggcacctacacccaggggagtagaagactcagcaccgttttcagatcactcattcatgaggtcacagcaattttcagatcactcattcatgaggtcacagcagacaggggcacagcagacagctccttaaacatagagatgtgttgttcataggaaatcttggcctttgctttcctgtcggagtttgagctggtggagtgggggtctcagagtcccgtgacacatcctagaatctgttaggacttaaggaaaatgggttgaggtagggtatcagggtggcctatggcaatatgggctggaaggaaggccaccccagagaaactcctgtgcctttttcttttgacttgatattcatgggctgatgtgtgaggtgacttggtacctttgtcctgggcacctggaatcaaaaactgaagtcacctttgggaccatcaaatgcatcttcattttccagtttgcctgcattgtgccaaggtcccgcagctccaacctgattccttgcactctgactcccacctggagctctaatcccttctctctgtctctcctgatcccgtcactctccttcagcagctttttcttgttaaattctcacactgtggcaaaacacgaaggaagatgaaagggaaatgttgtaggagggtccacatgagctatccctaggccttccaaaataatcttgcaaaactcttttgaggttacagatgggagccactgggtctacacagtagcagaaattgcttaaaagtaacaagagttgacccaataacaacatgaaagacccacttaggcttacctaagactaacacagcttattgtggttctgctttccctgtgtagacagatggcttggtcacactgcttccttttgtccaggctggttagatcccacctggcagccccaccatttgttcccaccagggggggcggactgcctcacgcctgtggtcatcccactagcctgaaggaggcctaacagggacctttcagatttcatctccaaatgccaggagcagggagttcccacagtgctttcaggcgcagccacctctattggtgcctacatcacccttctaggcatacattctgcctcatggagggatggcagcttgtgggagggagggatgctgtcagggggccagcccctgtgcaggacatattcatctacatcatcttttatcatcacacacatgatttcctaatcacacaggtgagaaaacagatgcagagaggtgaaggaactgctggaagctacacagatagtaggtgggacatccgggtttggaacacagctagaggattggctccacacctgggttcttttcgagatgttccattgccccgggggctattactccagccagggaaactgaggctggaggatgggccacactcagcaagaggggctgggggctgtgcaagcaggaagctctgccagctcttgaccctgtcagcctccatccagacaagccattgggaatgaagttagcctcttcaggccattcttgtctaaatgttcctgtccaagttcttcataagattcatcttaatgaacattttgaaccctaaatccttgaagggtaggaatacccatacccttttctgttcctcagtatctagaatatttggtgtgtgtttatttctcctggcctgagtttatctctctgcatttttagaattctgatagcactccaattttggccttgctttgatgaaagggaaattatcttgatgaatttgttgacacaatgcatttcatcctaatcgtaattatagtaagtaatatttattgagcacctgtgtaccagcactgtgctaagcacttcacatgtgttaattcattcgatccttatccctgttttataatgcaggacatagaagctggagaggctaccctgccgaaggtcactttggtagcaagtggcagaaccaggactaaacctttttttttttttttttttatgagatggagtctcactctctcacccaggctggagggcagtcacacaatgatctcagctcactgcaccctccacctcccatgggggttcaagcaattttcctgcctcagccaccggagtagctggaattactcatgccaccccgcctggctaattttgtatctttagtagagacagcattttcaccatgttggccaggctgatcttgaactcgtgacctcaagtgatccacccaccttggcctcccaaagtgctgggattgcaggcctgagccaccacacttggtctaggactaaccctctttatcccttgttgcttacttctatgtgatgactacatcctctgcagccagctttcatctgctttagcaggttgataaaataggcccagcaaccccttatagggaagaaagttctgggttgcttggggggctccagaaggtacatagcccttggtgctttgtgggaaagcctgcagagaagaaaactgccatgaggaattccccactcaacttcatcaagtctagtcctactgggggatattgcagacaagcagtactgcagtgagccatccagctgatcctgaatgcacacacaaatacacgcatgcacacaaatacacacacgtacacaaatacacagtctccatttcctctctctattcggttaatgcaagcccagttccaccagatgaacatagtgcaagctgtgtgtgtgatccgggtccttcactactctacacattttgttcactgaggctgcattttgctgccctctttttatttctctaaaccaggtacctcccacagtccatttgacagctgccttgaaagctcactcacccaaaaggtctgctcctgacttgcctgcactggaagcctgtgatctggtttgggatgttcattcatgaatgatgccattctcccctccaactggaggcaagtcacaggaagctagttaaaccctgtatcatagactgccatattgacatcctctcaattatccaaccctgttggtgccatttgaacttctcccagcacctgctggctctaaaaacacagcaggcctgctctgttggaagcatcccatcaatttactaattagctcttttccctggaaacctattgttgagtctgaaatcagattcaaaatcaatatgtaagcactgaaagttcatacttacatgcagaatttaaggtgtaacaggcttccaaatcaaattcatctcctaagagctagtagtctaaacttcatacatcatagaattctagatcaagagagactgcagccctaaaagggaagtggcttgacaaagctcccagaggcagagctgggactagtttgggtccaatacttgcagtccttctgccctctgtgttgccactgtcccagcccacctgcaccccatgtcccactccatatacattctagggtcatagaagaatagcagactattggcttatttgcaaggtcaaatgcttaagatgtcaaaaataatggaaactgaggtccccagacaccagacaactgaatttcccaaatgctttacgttagtgatgcctaaaaagcacccaggaatcaaatggggagtctggagagcttctcctccttacaagaataggctgtgtgacttcttctttctgaaacccatctttgcataaccaaatggcagtgcccattgatttcttgaaaagaaacatctgtgacttcctttttaatggcaagaaaggtattctccttgagtcagagcagagagtcaaattacctcgaaatactttttttttaatctccaaggttggagaccccagaattcaaattaagactatactacgggatctcccaaattttatagtattgaaattcttaatcattttgacccaaagaatgtatactctcagtgggatcttccctccttgctctactttcagtaaaaccagagcaggtgcttactttaattcactaatgtactggcatttttttttgcataaataagtaactgaacagtagataatccacaagtaatgtctacttcgcaataggtatgtgaaatcttttgcttgcacaaaattttcctgccaatttatgttttcttcaaggaaaagccgaccttggttgtgttttcaggggttagttctgttttcaactagctataggggagtagccctaatgcatttggggcaactggagaggccaggccaggagaaatgactaatgtgccacctccctcccggcagtgaccgtgactttgcttctcacgtagtaccttgtatgcatcaataactttttttcatttaatgaaataaaatcagggttgcctctatatttttgctaattcagtgagaatcttcgcttatcaaagtgagggctgaagtgaataacttgagagtggtttaactgaaaagatttttgtaatcatggtcagaagaaaacggtactgttatcaaaacttgccatatcaggctaggggatattgcacaagttgagacccaaatgtgactgacagtgtgaccctgataattatttacaacactgccccttctttctgcaggacccacactttttctgttggtttaacctagttataaacaggataactttttttctgctgatgtaccacttgctgaatttgcatccggtgtctataaacctgcagtttctgaatgtggttgtcaggatacttgcataatggttacgagcatggaatagtttcagagatggggccatgaagcaggctgaattccttactcaggaaatcgactgggaaataaagtaagacggtatttgatttgctgttattagtttgtcccagctactctttacattaactaagaaagaatgcaataaaaatgaagtctaacagagccctcagttccaatccagagaacggagtattaatcctggaaccatcgaggatctgtaggatttaggaagacaaaagctttgccactttgagggtctgttttccattatttaacaaaatgtggctaatgcctttttgtaaaacaatagacataagtatatttcaaaaaaaaacttgaaaaaaaatactatagccatagggctaggcacagttggtcacgcttgtaatctcagcactttgggaggccaaagtgggagaattgcctgagtttaggagtttgagaccagcctgggcaacatactgaggccccatctctacaaaagattttaaaaattagctaggcatggtgatgcgtgcctgtggtcccagctacttcggaggctaaggcgagaggattgcttgaacccaggagttagaatctgcagggagctatgatcatgccactgcactccagcctgggtgatacagcaagactctatctcatataaataaataaatagtatagccataggtttttaataaagggcttcagtcccacctagagtttggggaatgtcaggagaaacggtagtttgcaaagcagccacctttaattagagaagctgcctgcacacttagccttatcagaaacggggatacaaacaatagaacagggcttcccacagtgaagcacagagagctatagggatcatgctcaggagagttctcaatgaaaagcaatgcttaaaataagtgaagcgaagctcctatgtattcagtgtgccctcagttttgcagagggagggaggggaatgggattcctacatcaaggctaagagcacggactggttgggcttccgcacttcctagctgtgtggcctgggctgacttactctgtccttttctgcctcagttcctccatctgtacagtgagaataatagtgtccatctcaaagcatcgctgtaagaattaaatcgagaaagtacgtgaagcactttacacagtatctgagcacctagaagcactcagaaaaagcgaatgcaaaaatatgtatagaaaataagctcttagttacttccagtgactactgatttttcttttttcttttttatactttataaacttttaaagttccagcagcaaaaaggcactacttttgttttcttttcttttcttttttttcgagacagtgtcttgctgtgtagcccaggctggagtgcagttgcgtgatgggctcactgcagcctctgcctcctaggttcaagggatcctcctgcctcagcctccctagtagctgggatgacagccatgcggcaccacacctggataatttttatatttttagaagagatgggctttcaccatgttggccaggctggtctcatacgcctgacctcaagtgatctgcctgtgggcctcccaaagtgctgggattacaggcatgagctaacacacccggcccaaaaaggcactgcttttctaaaaccaattttattaaaggtatgtgtacatgaagtgacagtaccctcaactgagtgagtggtgctagaaaaggtgctggctggggaaggatctatggattatatatttcaactgccatgtgtttagatgaggaaaccgaggcccagaatgaccaccttcacagcaagctgagactacaagccaggtttccagaataggcagggatgaaagcactggacaaagcctgcctgtccggcactaatcactgggtacgcagtgacgacatgaaccaagggaatgaggagaagggacagcggctgtaaaggatggaaagagtcaaagtgacttcgaggcttcaggtctgggggcttggaagaatggagactgaaatgggcagttagtgagagaaggggtttttatatgaagaagaacatgcgtttggttttgaatgttgtcagccttgagaaacatccgagcaggttttacctacggacagtttaagatccaggcctggagctgagtgtcaggcaggaccaggaataaaaacctgggaaaagacttcataaaattaaaagatgaagtggtataaacaaacttttcaaagttcaaagaataggccacagtggaaaatagcaaagggtcaaaggatgagtggagagggccaatcgaaattaaaatggggagaagggccatctaagaagagatatgggcaataaagctgaggactcggtttcaaggtgggctcaactatacacagtctgaaattcaggaaggaggtcagtaaaaataaagctggaaaaagaaaccaagcgtcttttgaattagactaggaggaagtcactgtgattaaaaaagcagtgttagagatgggaaatgaagcagcccgaatcccttacataatttttttttttttttttgagacggagtctcgctcttgtcacccaggctggagtgcagtggcgggatctcagctcaccacaacctccacttcccaggttcaagcaattgtcctgcctcagcctcctgagtagctgggactacaagcatgagccagcatgccctgctaatttgtatatttttagtagagatggggttttgccatgttggccaggctggtcttgaactcctgacctcaagtgatccacccgcctcagcctcccaaagtgctgggattacaggcgtgagccaccgcacctagcccttattcaagaatttagactgggaaataaagtaagaaggtatttgatgacagtggagagagatggcaaagcagggtcatggcttattcaagatgaaggactctatgaatatttgaaagcagaagggaagagatgaagaaggagattaaaactttcgggaggtagaagataaagcttggataagggtcctcaggaggcaaaaaagcaagagaacaaggcaaggctggaatcactagcattatatcccaaggtatctctccttcctgtcacttgaatgatttgagttttaattattttggaagtcttaggctattaacaaggacctgaaaattccacttatgtatttcttcttttctagaggaagcagttcatggcaaactgagcatggtaaccttttctcctggtgcggtgtggttgaaatctcaccacagtatttagcacgctcgtcattaaatcactgcttgtgttgctatttgctgagtgtgattctttcctaatggactccatgacaggagcacccatatgtgatctttcgaccactgaatcccagtaatttgtacagttccaaacatataataggagcccagtaaatattagttaaatggatgaataaaggaattaatgaatgagcagcctctcccacggaaaggaaactcatattcagggagatgacacaggatttacattattcaatccggcaggttagcaagcacataacctctttaaacactatttggtaaatggtcttgagtttttcttttctttttttgcaggggggctggtgggggacagagtctcattctgtcccccagactggagtgcagtggtgcaatctcggctcactgcaacccctgctgcctgtgttcaagcgattttgtgcctcggcctcccaagtagctgagattacaggtgcctgccaccacgcctggctaatatttgtatttttagtagagatgggatttcaccatggtggccaggctggtttcaaactcctggcctcaaatgacccacctgcctcagcctcccaaagtgcttggatttacaggcgtgagccactgcacttggcttgagtttgtcttggacgcctttctagtacttaaaagaaaaattacacaccccaaagctatcatagaagttcctagaagagttaatgggtgcagcacaccaacacggcacgtttatacatatgtaacaaacctgcacgttgtgcacatgtaccctaaaacttaaagtataataataaaaaaaagaagttcctagaagaatctgtcccttaaatgtagattcaaagcaaatttaaacagagaataagtggcatacaaaatactgactttctgtactgacttaatggcagttttattcctttcatgtctgtaaaatgggaataatggtaaggggtgctttgaagatatttaagattgaaaagcacttggagtctgatgcctttattgttcactacaagtattatctcatactttacttcctccaaaagtttaatttccaactttgtattttgattgtgatgccattgggttactcaataggcttatctttttgtggattttctatctaaaaaccttactacgtaccaaaaacagataagctccaagatccaagtggcacagtacatggaatgaatgccataaatatttgctgattgattgaataaatcattctttaagaataaaagtggcctcactgccatcatttcatctcaccctatatcaactttgtgagatggctgttacccttcttttacagatgagaaatcttaggctcagggaagttaagctacttgcccaacaccacccagcaccggcaactcaaacctgagctgtctgatgacccaagcctcatcatttcttttacctgctgcttctaacttggactttatatttttttgtttcttttttgttttccaccaggaaatgatgaacacaagcccttgagagagtggtttgtcattgtgattatggcaaccatctgcttcatcttgttaattctctcgcttatctgtaaaatgtaagtgttctttacatttgcgtgcttgcagtggggtttcagtactgcatttttacaggcttaccatgcatccggtaggcagagggttcttattatcaggtaaaatttgtggcatttttgtgcctagatgacctgtccaagatgagtgtaggccaaatcaaaagtggaaatgtccagaggtgatttacagaagttggacagagcacacaatgcagccctcagctatcactcactcctacctgaagttgtcgacagcttttaatttctgtgaaggtttctacttgcgggtttcttttgattccttctcagtcttccactcggtccttggctgtctagggtaagctgccagtataggcttttcacagctcagggaggctaaaatcaccacaatgcctgcatgtcatcatcctcagctatcaagtcaccaggcccctgagtggctgatggttattaggtcaaacacggattctagaaatcgcatgtggatctggtatcctatcctagagtccacaaatggtccataagtatcccttacccattttagcattcagtaaggcacaagaccttttaggaggcttaaaaacatgttttgtcttggccctttcataatttagaaaatgagttttataaggtccgggtgtgggggctcactcctgtaatcccagcactttgggaggccacagcgggtggaccatgaggtcaggagatcgagaccaccctggctaatgtggtgaaaccccgtctctactaaaaatacaaaaaattagctgggcgtggtggtacgtgcctgtattcccagctacttggaaggctgaggcagtagaatcacttgaacctgggagttggaggctatagtgagccaagatcgtaccattgcactccagcctgggggacagagtgagactgtgtctcaaaaaaaaaaaaaagacttttctattaaacagctttactattataaacgttatattcggatggcatctacagtttgggggaaggcagtacaaaggagatgaaaagaaagtaaactcggctggggatggtgactcatgcctgtaatctcagcactttgggaggctgaggctggaggatcacttgaggtcaagagttcgagaccagcctgggcaacatggtgaaaccctgtctctacaaaaaatacaaaaattagctgagcgcagtggcatgtgcctgtagtcccagctactcaggaggctgaggcaggagaattgcttgagcccgagaggtggagattgcaataagccacgatggcgccactgcactccagcctgggtgacagagcaagaccaaaaaaaaaaaaaaaaaaaaaaaaagtaagtaaactctgtgagtaaacataattgaggaaggaatgcttcaatcagcaccacccacttgaaatatacagttcgttttcagatattaggcctggtaacacccactgacacaaagcagtttccatttggtcttccctggatgactcagggccacagcagaggcttgcggtacccacaaagtcttcacctataattttggaagtcttggtacgtaaagattttgaatttacaaaacagcaggttctagaatcaaccaggtcaatttttagagtagatatttagagacaaaaggtatactcatgctcacctaattccttctttactctgttttcagatgtcatttatggatcaagttgtttccaccaattccagcaccaaaaagtaatatcaaagatctctttgtaaccactaactatgaggtaatgttgaaagttcttatgatatgccgtatgtgtccagggttgagtcccctgggagctgtcattcggttcttagttttctatattataaggcagggtttttactcagaaggccaggagcatttctgttgcttcagtcattctgttctttggctgattcagttgtttgtattttttaagagatggggtcttgctatgttgtccaggctggtctcaaacacctgggtctaagcgatcctcccacctcagcctcccaagtagctgggactgcagaagcatgccaccatgcctgcttgcctgattgttttattatgcacgttcattactcttctgacatattggaaaggtactgagttataagtgttcttgacagttagacttaaattttaatttcatatcagccatgccttaactgactttggacaatctcttcaaccctctgagttctgaatttctttctggtataataagggacacagatgagattgtacaatgttctgcttagctctaatgttttaagactccatgtttccacatgaatatcttagttaatagagaattttcagagggaactttagctctttagtataaaaaagaccatagaaaaggcaaattattttacccaatatgcattttcttaggcctgttcaccattcagagcgcttaggttcagcccagtggtcacttagttatggctctccaattgttccagcatcatttgttggagtaaatcatcctttccccagtgaattgccttggcatttctgtaggaaattagttgctgtatgtagttggttctatttctggactatctgattggttttatcgatctatttgtctatctttatgccaatacaatactgtcttgattactgtagctttatcgtaaaccacgagaccatttgtggaaggcctccaaaagtgattttttaaaaatttgttttggttattgtaggtcctctgcattttcatatacatcttagattcggctgacaattttctacaaaaaaaggtagctgggatttggggtgagattgtgttgagttgtcagttaatttggggaaaagtgacatcctaagtcttatctataaacatagcatatcactccatttatttaggttttctttaccttctctcagcaatggtttgtgatttttcagtgtatgattattgcactttgtcaaatttatccttaaggtgaacggttatttagatcagggctcaagaaactttttctgtaaagggccaggtagtaaatatttgagggacaaatggtttctgtctcacctcttcaactctgccattgtagtgtgaaagtagccacagaaaatgtgctaatgaatgagcgtggctgtgctccagtaaaacttcattttccaaaacaggcaacaagccagatttggcccgcggctgtagtttgccaacccttgatttagatcaaacagttttcttagcaaatttaggtttctctcaaatgaagtaactcatgattggatgaaccacctggtgactggttgtagggaaaagaaagcgttcgtggaaaaactcaccaaaatgattaatttcaataagtggtgaactttccttagcatttgcagtttgggtattggaaggatttatagacagttacagttactagctgactgaagtagagaatggaggctggcaaaagaatcattctgcccatggttggatctttgtgttctcctttatcaggggaatggcccatctgctcttgttcactgagttctttgggaagaagagtgggccccagggtggagctttggtgcctgttctggatgtgtgctgccagtccctccttgctctagcacacttacccctgagtaaccacatctggttttgtttgtttgagatggagtctcgctttgtcacccaagctggagtgcagtggaaccatctcggctcactgcaacctccacctcccgggtttaagtgattctcctgcctcagcctcccatatagctgggattacaggtgcccgccaccacgcccagctaatttttgtatttttagtagagacagggttacgccatgttggccaggctggtcttgaactcctgacctcaagtgatccagccttcccaaagtgctgggattacaggcatgagccactgcacccagcccacatctagtttaagcagccaactgaagtcatttgtcctggcctcttaatggaacatcttaatgctggtatctaatttccctacagagccccaaaagatttcctttaatattccgaagttggtgaaataaactggtataaaagcttattgtataaggttgtgatttgttgttaattaaaatcaagtcatgtgtgtaaaataacaacttggggcagacaagctggtttcagaataagcagaggatgaatgacggcactccacagcgcctggcttctcaggacaacttattctcttctcacattgcagagtttcacataaaaacaaagcagttagagactgagagaagaaagaaagagcacacagaatgggagaaatgaagtactgcctggtgctgtgggctctatggcctaaattctccacctgagaggggatgagagccagtgcagagctgcctacagctgggccccatgaggccgtgcacagcctccacgtccaaggacaaaagccatccaacccattctcagaggctgtgctacaagggtgacaagagggcacattggtgctatgggcagtggccactgggaaatgtttggctagtgggaaaggaaaccctctgcttttcatggtaatgtgcacctctgagcttggggtgggtgcccaaagtcccaggacttagaggagctctgccaccctagaagcaagtttttgcttgttcagacctcagttagaaatttggacgtcagtgaagggccggtcacagtggctcatacctgtaatcccagcactttgagaggccaaaatgggcagatcatttgacctcacaagtttgaaaccagcctggccaacatggcaaaaccccatctctgcaaaaaatacaaaaattactcaggcacggtggtgcacacctgtagcctcagatactcgggaggctgaggtgggaagatggcttgagcccaggaggcggaggttgcagtgagctgagattgtgccactgcactgcagcttgggtgatgtagccagaacttgccaaaaaaaaaaaatacacacacacacacacacacacacacacacacactgtgaaggaagaaagttggcctttagcagtcaaaaagaaaggcttattctaaaaaagcatatcctgaattttctgataatttacttatttagacaatttttatagagacaagatctcaccaggctggtctccaactcctgggctcaagctatgcgcctgcttcagcctcccaaagtgttgggattacaggcatgagccacgccacctggcctgagctttcaatttatgagactggtttccagctgttccttgtttctacaatggccaagagagggttcctcctccaattaggttgcccgtaaactattaacagtaaaatggataaaggcaggagccatgcctgctgtgtgcatcagtgaattcccgagacacggcactgtggctagtgtggagcagatagtaaaaaatattttggatgagtaaatgagataaaggaataggatctcttacaggcaattttattttttgttaccaattttccaattattatcagcactattcattatagccaaaatgggtcagaactgtccaaagttagggggatactgtagtaaattatggaaggaatatgatgaagctatcaaaagtgatgccgccaaagcacatttaacaatgtaatttacaatcagtgatgtcagagagaaaaaaatcaatttttaaagatgtgtatccggccgggcgtggtggctcatgcctgtaatcccagcattttgggaggccgaggcggggggatcacaaggtcaagagttcgagaccagcctggccaacatggtgaaaccccgtttctactaaaaatacaaaaattagccgggcatggtggtgtgtacttgtagtcccagctacttgggaggctgaggcaggagaatcacttgaacctgggaggtggaggttgcagtgagccgacatcatgccactgtactccagccagggtgacaagagtgagactctgtctaaaaaaaaaaaaaaaaaaaaaaaaaagatgtgtatccatatgacttcaagtaagtctaaagaaaacattatgcctagaaagaaaggcttaggagaagcagtgggctgtgtttgggagatagatgtatggctaggtattttcttcttcttcccactttatttttcacatcttctttgtgaacatttactatttttatttaaaaaataatagacttaaagccaattgtaaagatttcaaagaacccaaaagttctctaaaagacatctaaggaaagatgatttgttttgcagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatatcaccccatatcaaaagagacgacagattttgttcaaatattatattcttgaaggaagccttaatattctggaaatgtgctgaggaagtcattgagcataattcaatcatgaaagggaccactgaatcaagaatgaactttctgaagagatgtttgctgccaaagacttcagaacaacttgttggtcaagtaatgccagatcaatcctagtctctcaagtttggaaaagtttctacaaggccattccatcaaatatcccaatatacacagaaattcttcttcctaacatcttcatatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggaggtgctgcaatagttggcaaaatgtttaaaatgtttggtcactcaaatgattcataatctcaaacctgtttttgttttttttgtttttttttttttgtggggtgggtggtggagacagtcttgttctgtctcccaggctagagtgtagtgatgtgatcttagctcactacaacctccctgtcctgggctcaagccatcctcctccctcaccctcccaagtagctgggactacaggtgcataacaccattcccagctcttttttgtatttttttttgtaaagctggggttttgccatgctgtctaggttcatctcgaactcctgggctcaagcgatacaccggcctcagccttccaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagacagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccattatctggcccttggtatatgtg

SEQ ID NO: 14486 - DNA, 7761 bp, Human
caagttgtagtatcgaggaagaatatccacagttatctgaaaaggctcttgggctcaatccatcctcctgcttcagcctcacaaactgctgatgtcacaggcatgatccaccacacccagccttatggttctttctaagttgaaaattacattaaggaaaggaactgtatcttattattccttgttgggtcttacatactataattgactaagaaatatttgtttaataaattgaataagtacatgattattttaagtctttttagatcataagccttaattgaaagcaatggttgtcatatatttctttcattttcccagaggctgagaggacagacagctttattcacgctttaaaatgcttaaaatgtttaattagtactttgttgtgtcgtacaaagaggtaggatcttcagtttgaatgttacctctacatcttactgtgtaaacttaaataaattaatgaatctcacaataccttggtttctgtcttagagaattagaaataaaaatgatacccgaggtgatgaataaatgattcaatatgttatggtttgatttgtgtccccatccaaatctcatgtagaattataattcccagtgttggaggaggggtctggtgggaggtaattggatcatgagagtggatatcccccttgctgttcttgtgatagtgagtgagttctcaggagatttggttgttaaaagtgtgtagcaccttcccctttgctctgtctcctgttcccaccatgtaagatgtgcttcccctttgcccttccaccatgattgtaaatttcctgaggcctccccagccatgccacctgtacaccctgcagaaccatgagccaacaagacctcactttacaaattaccccatctcaggtaggtctttatagcaatgcaaggatagactaatacacaaaacatgtgaaacactgtcagtgttagtatcatcatcataatcttcatcatcaattaaatagcacaaaaaggaatttgattaatacacaaaacatgtaaaatttgactaatacacaagactaatacacaaaacatgtgaaacactgtcagtgttagtatcatcatcatcataataatcatcatcaattaaacagcacaggaaggaattttaacccacagttaaagccccattttatttcgttattgattatattttccttcaaagttttgtggtaagctttgattttgaatacaagtaatttaaatagaagaccatgtaatttggacaaatttccacaattcagatagtgaagaataacttgggagtctagtggggagacgtatggttctgcttttcttcttattggctttggcttctttttcttatctattccaattagaagagagacacttaaattcactttaagcatggtgatttgtgataatatgagccccaattcccaaagggcaaaaataattatgaacaaagctaagtcaccctttatagcagggatccccaacccctaggctgtggaccaataccggtccgtggcctgttaggaatcaggcagcacagcaggaggtgagcaggagggtgagtgaccattactacctgagttccacctcccgtcagatcagcagtggcattagattctcataggagcgtgaaccctattgttaactgtgcatgcaaaggatctaggttgtgctctccttatgagaatttaatgcctgattatccaagttggaacagtttcatccctaaaccatccttttcccaacactgcccatggaaaaattgtcttctgtgaaactggtccctggtgtccaaaaggttggggaccgctgctttatagcattcttttttggtggggctgagcctggcctcttggctgagtttatcattaccatttatctctgaatcagttatttgctattgcctcaatgtctttagtttaacagttaagttcttgaaaagctacgttggggagccacaactttgcgcgagtgtcttggttgagcgcagcgcccattcattgcccgcgagcgtccatccatctgtccggctggcggtccagcgaaaggggctccaggctggacgcagccgccacccgggggaccgaggccaggagaggggccgagagcgcggctgacccttgcgggccggggcaggggacggtggccgcggccatgcagtcctgtgccagggcgttggggctgctcctgggccgcggggtcgggggcggccgccgcctggctgggggatcggggctgtgctgggcgccgtggggccgggacagcagcagtggcggcggggacagcgccgcggctggggcctcgcgcctcctggagcgccttctgcccagacacgacgacttcgctcggaggcacatcggccctggggacaaagaccagagagagatgctgcagatcttggggctggcgagcattgatgaattgatcgagaagacggtccctgccaacatccatttgaaaagacccttgaaaatggaagaccctgtttgtgaaaatgaaatccttgcaactctgcatgccatttcaagcaaaaaccagatctggagatcctatattggcatgggctattgtaactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccagtgcatccctgctggatgagggactgcggctgcagaggcgctgcagctgtgctacagacacaagaggaggaaattttttgttgacccccgttgccacccacagacaatagctgttgtccagactcgagccaaatatactggagtcctcattgagctgaagttaccctgtgaaatggacttcagtggaaaagatgtcagcggagtgttgttccagtacccagacacggaggggaaggtggaagactttacggaactcgtggagagagctcatcagagtgggagcctggcctgctgtgtgtgctactgaccttttagctttgtgcatcttgaggccaccgggagaatttggggtagacatcgccttgggcagctcccagagatttggagtgccactgggctatgggggaccccacgcagcattttttgccgtccgagaaagcttggtgagaatgatgcctggaagaatggtgggggcaacaagagacgccactgggaaagaagtgtattgtcttgctcttcaaaccagggagcaacacactgagagagacatggctaccagcaacatctgtacagctcaggccctcttggcgaatatggcagccatgtttgcaatctaccatggttcccatgggctggagcatattgctaggagagtacataatgccactttgattttgccagaaggtctcaagcgagcagggcatcaactccagcatgacgtgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgcggatctttgtttgtgagtcatctgcagaactggttgctgaaagcatgggagaggagtgcagaggtattccagggtctgtgttcaagaggaccagcccgttcctcacccatcaagtgttcaacagctaccactctgaaacaaatattgtccggtatatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggaccaagctcaaggatatcagcagcttttctgagagcttgagaaggatttgtgtgaactcacaggttatgaccaggtctgtttccagccaaacaggggagcccagggagaatatgctggactggccactatccgagcctacttaaaccagaaaggagaggggcacagaacggtttgcctcattctgaaatcaacacatgggaccaacccaacaagtgcccacatggcaggcatgaagattcagcctgtggaggtggataaatgtgggaatatcaatgcagttcacctcaaggccatggtggataagcacaaggagaacctagcagccatcatgattacatacccatccaccaatggggtgtttgaagagaacatcagtgacgtgtgtgacctcatccatcaacatggaggataggtctacctagacggggcaaatatgaacgctcaggtgggaatctgtcgccctggagactttgggtctgatgtctcgcacctaaatcttcacaagaccttctgcattccccacagaggaggtggtcctggcatggggcccattggcgtaagaaataccttgccccgtttttgcccaatcatcccatcatttcactaaagcggaatgaggatgcctgtcctgtgggaaccgtcagtgcggccccatggggctccagttccatcttgcccatttcctgggcttatatcaagatgatgggaggcaagggccttaaacaagccacggaaactgcgatattaaatgccaactacatggccaagcgattagaaaaacactacagaattcttttcaggggtgcaagaggttatgtgggtcatgaatttattttggacacgagacccttcaaaaagtctgcaaatattgaggcagtggatgtggccaagagactccaggattatggatttcacgcccctatcatgccctggcctgtggcagggaccctcatggttgagcccactgagtcggaggacaaggcagagctggacagattctgtgatgccatgatcagcattcggcaggaagttgctgacattgaggagggccgcatcgaccccagggtcaatccgctgaagatgtctccacactccctgacctgcgttatatcttcccactgggaccggccttatattccagagaggtggcagcattcccactccccttcgtgaaaccagagaacaaattctggccagtgattgcccggattgatgacatatatggagatcagcacctggtttgtacctgcccacccatggaagtttatgagttgccattttctgaacaaaagagggcctcttcttagtcctctctccctaagtttaaaggactgatttggtgcctctccccagagcatttgataagcaagaaagatttcatctcccaccccagcctcaagtaggagttttatatactgtgtatatctctgtaatctctgtcgaggtaaatgtaaatacagtacctggagggagtcgaagctgatggttggaagacagatttgctttggtattctgcttacatgtgtgccagttgcctggattgggagccattttgtgttttgcatagaaagttttaggaactttaacttttaatgtggcaagtttgcagactttatagaagctatccaggagacttaatagacatttttttgttccaaaagagtccatgtggactgtgccatctgtgggaaatcccaggacaaatgtttacattttgtataccctgaagaactctttttcctctaatatgcctaatctgtaatcacatttctgagtgttttcctctttttctgtgtgaggttttttttatctgcatttattagtattctaataaaagcattttgattggaaaacaaaacacaacaacaaaaaaaagaaaagctacatcggaatccatgtaatcttgtttgagaaagatagaaattgatcctttcagctgtgattataggttactgcaagattcccaccctttctgctggagtgttgagaagtctggcccagaggtcaaatcatactttgtaatcttgaactaaatagtgtttattacttgatgcttataagtactgttttatttttctcccctagatgcaaaccaagatttcactttctaccctgagtgcgattgcaactccaagaattatagagcttgcccacccaaggatcaagttagagggtctgtgctatgaaagacaaagaagtgaactgcccatccgtcctgtaagccatcgctaccttggtatccttcagctcactttttggctgctcttaggatgctattttgcctctacagggcatagcccaaagtcactggaaaagagaatctgggaagagtggtctgtggcaggaagagagactagctagatgatagggagagagggaaaagagtagaacaccaaaagcatgggctttggagttcagttttggagctggattcaaattgcagcctcgtcactacaagctctatgatgttgggacaaacttcctgagctttattcattcaacaaatatttggatgcctactgtgagccaggcagtgatcccagtgaacaacttggagctctatgctaatcaggggagacaaacaataaattagtcaatagataatgtcagatcatgctaaatgctatcaggaaaataacatagaaaatgaatgactgtggggcagggtggtaagatactttgcctatggtagtcagtgaaggcctctctaaggaaggaatatttgagctgaaacctgactggtaagaaggagtcaaccaagtgaagatctagaagaatattccagtaaagggaagagtacatgccaaagtactaaagttgggatgcacttgaaattgggtggagcaaggtgagctagagaattctggagatagccgccctcaccgagtggtctgctgtgttgagcaataacaggtaagtcatggcactcagcacagagcctggaacctttgatggcttccctccctcttcatccttgacattccccaccatcaattgcagtgccaacttggtgccctattccaattgggttttcaaaaaatatctaatgatcatgttgccaaaagaggtggggccagtttcaccctgtttcaaggaaactgaggatttaatatggaattctattaggaaagaaaaccattctgggaatcagaaactcttggacgagtgtcttaagtttactaaagtgacttgtgactgtcaggcaaatgactttattctcagttttttggtatgtaaaaatggaagtaatggagatctttccttaattgctaggattgtttgggtttattttattttttaaggtctttagaaaaaaggaataccactgcagaaaatcatagtcttagaacccgaaacaaatctgcaccagtgcaatgcagaacactttcaagactactgagagtggtgttagctgtcctccctaattcttttgtttgttttttttgtgatggtggtgttttttttttagacagtgtcttgctctgtcacccaggctggagtgcagcagcacgatcatggctcactgcagcctcaaccttctgggcttaagtgatcctcccacctcagccacctgagcagctgggactacaggcatgtgccaccacccccaagttttaaaaatttttttgtagagacaggggtctcactatattgcccaggctggtctggaacccctgagctcaagtgatccttgtgcctcaacctcccaaagagctaggattataggtgtgagccatcatggctagccccactctaattcttttgagtgagcatttaaaagagagtagtagatgtcatcctaggtattttaccaataaagcaacataacagaaaggcaatctggtagatgtgg

SEQ ID NO: 14487 - DNA, 30843 bp, Human
  misc_feature (1)...(30843): n = A,T,C or G
taataagacatttccagtaagcagtcagattgaggaaatgaaggacatttagtaagtttaacaagagacatttcatttttgcctttttggacctaaaaaagggaaagaaaacaagtttatgtctttgacaaccttggtagaggcctgaattgtaccctgggctacagcatctaaaaaagccatgtgacctcaaacttgattttagttaaacaaataaaatatatatagaaaagtttgtaccagtcctaaaaatgtcgatcttcctttcctccctccctccctcccttccttcctgtctctttggttcaatgaaaatgaatacttttcaggtttgattcatggagaggtgttacatttgaaattgcctcattgaaacttttggtggtcgagcaccttagggtcttcatttcatcttgcatcggagactgcattaattagtaatatattgtccagatagagggaaacagaggtcctatgtgggtataccaggaaatgaagagtctggaagccctgccctaagagaaacaaataaaggaacttcaaagagaaggaagtgaggtaccctgaggagaagctgggatgtcttaacaactgctttgggattttgagcttgcccttttcactgtgtagagtgttccttgccctactttccacctgttgaagttttcctcattctccaaggtcagactgaatacatctactgtgaaaagtttctagaacctcttgggatccatcttcctactggcaaacccccatagcacttgctacttatgttgtaataccaagcaatagtcagacttatctaggtcaagttaagtaggggcttgaacgccacactaaggggtttaagctttaagcttgtagtcatggggagccactatgcttctgaggacaggtgtgacttacgactgacgtttaggaaggtatcaaaggcagactgagaagctctttcaggtgtgaaagggggtggaattactctctctctgttcttttttgttgtttttgtttttgttagcacatgactatgggctaggcattccgcttggttatcccgcttcatagacgtgagcccggttactccgacacaccgtggccccaggcagcctccccgtcctcaccaccttttcttctgtcatctgagggtaattcctcccctgcagtcgtgctttccgggctcagcaatgacctgctacctgccacgtctagggatctgtcccctcagtcctcacgctcacgctttctgagtccataacctccttcccgaaacgttttcttctcacttctcccaaactgactgcattccccctccggtagtttgaaatttggaagactttttttttttttttttttttttaccgcagacgcttaaaacgaagcttaattagtcaaggacagctatgggtggagacttgaagagatctgaagggtatcttggagcgctttagacttgagaggccggtgacaatagctctaaagagacccgtcaaagcctgcggattcttcttttaacagctctattctcatgcatgcacgccagggctggggggaacttttgttgtttgtttgtaatagaaatcgagaaagggagtggggcccgcctcttttctgacctaagggcaggagtgaggggccgggaggattacgggcggctccccctagacgcgcccccaggcgagctggagactggggcactccttgcttggtagaggggcggggcgcgcctagcggccacgcgcgcgggcgtcggagggggcgtgtctcgcgggcgcgcgcgggcgtcggagggggcgtgtcccgcgggcggtggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgcggcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccggtaagtggggcgctgggctgggggctcggtcagggtgggggagggccgcccgggcggcggcagtggcgggagggggagggcgcggaaggacgcggagtcaggcgctgtccagggctgatttgcagatactgtggctccggcggcggcggccccgccgggcgggggctggcggccgagcaggatcgggttacacagcagccgcccgggggctgggggcgtttgttgggagcagcgcgtcgcctggaccccctccccactggaggctgggacgccgcctccgcgctggcccggacgctccaccgagtcaggtcctttgaggccaaggagcggagctgctcgggcccgtagtcctgaaacttcctctgcttcctcctcctgcccccgggtcccaccgcagccccgcgccggcccgcggccctcctggccccctcccccagggcctctccctgtcgccggaaggcgccgttgagtgcggccgggcgggttgagtcagccccggggcccgggcggttccgcctgcggggctggacagcgatttctgcgcttcagccgtccggcgccgctggcccccgcgtccggccacccgaccgctggagctggcggggctggggcgcgcgtcctgccgggcgccgtgggggagtgaagttcgcaaacttccggggcgcgggggtggcggctggcccgtgtgggggccccctccggcgctcggagcccgacgcctcgcgagggcgcccgcggagcctccccggccctgggcgttgggcgagccccggggcggtcggaggggcccgggggcggtcggagaagcccggacgccggctgcgcggtaactttccgtcctctcccgggacgggggccctagggctggggagggggctgcctggactcggggaggactggttccggccaaacagcgcctcgagcttgatcccctcccccgttttagtgttggagagcgcaggaaaaggctcaggacgagtgtcggggcgactcccgcgagttggtgtgtaaatgtgtgcagtgagcgggccgaggcgagaggaagcgagagcgcccgagtttgcaaagagctgctttgtgtttggtattttgagaaaatggccgaatgcctatttcagttaggaatgccgccgccgaggcaggcgctggtggcagcagcacggaggaattcgtgcagcacgttgggctttcgggctgtgcctggacggtcttcctaacaatcgttaaaattccatttggggtggcagttaggggttagggagcaattagaaaagtcgatgttgggccaaattacccaatagcttgggctgttcagccccgggacagccttcgccctctgttttctgtgatggcatttgcttccaacttttgttggtacgtagaactaaaccggtttgtgtttatacacttgggtgaagcgggttactttttgtattttcggtttaactttattttcttagaacttcttactttttttaatttgcgagtgaacacttcgtttgagaatggcaccttttagattgagaagtaacgtagcatctagaaagcccaacttgttttgaagaaggtgatcttgtaatggcttccactaggcaagtaggccaagtcaagcacaatgcaagaaagttgctgattgtcgagttgagttgcacgatgattttattcgtattgaaaagcttggaattcagtgttgtggaacttcagcctgcagaaaaataagcttattaatttttatttgtgaagttttgaataaatcaaacttcctttttcacaagaaaaggggtccataaatgttttttcttttaagcctgtggagttgtcgaaaaattaaggggctgactgctactttttcacagtagtttattcttttggagttagttgagttcatgcgaaatccaattaagttgaacaattattacaggcttgtactttccagatgtgtttgtgtacttaataaatgcactgaatggcttgtggatttctgggctttctgattcagaccattgaactgttgaaggggggaaaagttgggaggacaataatttactactcatgttttgaatttttaaaataattttaacagtaaaaatgaaggttactttttatccccaccagaacaattaaaagtgcttgaggaggcaccacatgccagtggctgaatgatgaatgagttgtgcaaacaattggtagaattgttttatagggatagtagaaatttttttttggtgattgcagtagactattgggaattaacaactattttaaagatttgtttttaataggcgatgaagtttactgagttataaagatcatactggaaaatttttaagttatgaagaattacagcgatgtggttttaagccagtaacagtagtgtttaaactggtgctcttgttttgttttgtttttaattcagaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaagctttctagtccataagttcagttctcttttctgattgttacttgagtggttagttaagtagtgcttgagaaaaaggactctggttcaaatccaggttccattttgctatctttgtgaccttgcacaagttgtttaacctctttgttcagaaatttctccatggagtaacaatatctaggttgggaggattatgtgaagttacatgtaaagcacagaggaacagccaagagattttaccgtggtcttactaaagtacatatcctaacttggggtttaccttcagcaagttagactggccgtgcatggtggctcacgcctgtaatcccagcacctcgggaggccgaggcgtaaggactgcctgagcccagaagttctagaccagtctgggaaacgtggaaagacccccgtctcaaaaagaaaacagaaaaaaaaaagtttgtgtatttatttctgtgacagtgaacacatttaagatgcagtgtagtttctgaaagaaattgagggcttatataaaaaggaaaactcagtgattaaccttgcacatgcccacttaacaaaagcctcaaactttaaaacatttgacttatagcattgagttcctaaatggaacaacttgtctttgtccacaaaaaagaaatgtgagaaggtagtttttaaaaggtgggtgggattatcaccaattgaaactattttcctatgaaagcaaacacttgtagaaaatgtatttttcagacaattatgtttagggtgtttgaactgatactaagcgcaactgtataaaaaaagttgaaactttttttttttttttttttttgagacagtctggctttgtcgcccaggctggagtgcagtggcaagatctcagctcagtgtaacctctgcctcagggttcaagtgattatcttgcttcagcctccctggctcagcctcccgagtagctgggattacaggcacccaccaccgtgcctggctaattttttttttttgagacggagtctggctctgttgtcgaggctggagtgcagtggcatggtcttggctcactgcaacctctgtctcccaggttcaagcagttctcctgcctcagcctcctgagtggctgggactataggtgcccaccaccacacccagctgattttgtatttttagtagagatggggtttcaccatgttgcccaggctggtcttgaactcctgacctcgtgatccgcccacctcagcctcccagaatgctgggattacaggcgtgagtgccacccctggctaatttttgtatttttagtagagatggggttttgccatattggccaggctggtctcaaactcctgacctcaggtgatctacccactttggcctcctaaattgctgggattataggggtgggctaccgcacccagccgaaactttttttttttttttaatttctttttgtggagatggggggtctcactatgttgcccaggctggtcttgaacacctggcctcaagtgatcctcctgccacagtcttcccaagtgttgggattataggcgtgagccactgtgcatactagtcattcacttttaaattgggttttattcagctgctgttcactgtagtttttttaattggatttatttattcatttattgatttatttgagatggagtctcaccctggagcccaggcagtggtgtgatcacagctcaccacagcctctacctcctgggttcaggcagtcctcccatctcaacctccaaagtaactgggactacagatgtgccctaccacaccctaattttttaaaatttaaattgggttttaaatattgtaattgaggggcctcatttttcaaataaatgtttttaactattggtagctcatttggacatttctgttacattttcttggtaagaattggtacatttgggtcctgatgaatggatagagaataatccagtactctactcttggggtcacaaatgaatagggggtgtgggatgctgtttgcctcaggtctcctcttacaggagttggcacttgacaggactgaaccccactggtaaaggggacactgaggaggggaattgatgctgctttaagtggagtggtagacttaatttttgttttgttttgttttggagataggatctccctctgtgccccaggctggagtgcagtgacgcgatctcggctcactacaacctccacctcccaggttcaagcgattctcatgcctcagcctccccagtagctgggattataggtgcccaccaccatggctagctaattttttgtttttttagtagagatggggtttcactatgttggccaggctagtctcgaactcctgacctcgtgatctgcctcggcctcccaaagtgctgggattacaggcgtgagccaccgcgcctggccagttttttttttgagatagttttactttgtcacccatcctggagtgcagtggcgagatcactgctcactgcagccttgacctcctggacttgtgaccctctcgcctcagtcccccaggtagctgggaccacagacgcatgccaccacacctggctgatatttgtatggtagagacagggtttcgccatgttgcccaggttggtctgtaactcctgagctcaagtaatctgcccttagcctcccaaagtgctgggattatgggtgtgagccaccgtatccagcgacttaatttttaaaaatttattttatttacttattttttatatcccagatacttaaaactattaactggcaggcttaaacaataaaacttgcaggtgaaattccattacaagagtgacctctgttacaggattgctaagccccagcagatggatggctcatgtgttgaatgctttaaaatttagtccagtaaaagaatttgtagtccctgtggaatttgtcataagctgtgattgattgtctcgatgctttgaaaccattcgatttcagaagtaaaggtcaagcattacaaaaatacatagagtaggaaatgaaagttacttggggacacaaccccattaatcacttgacagtttgaattagacagactgttagactaaaccagccttacctacaatatcttaaatcccagccatcatatatactaaactcataaataagtacaccatattcatttagctgggattacaggtgccttccaccatgcccggctaatttttgtattttcagtagagatgtggtttcaccgtgttggccaggctagtcttgaactcctgacctcaggtcgtctgcccacctcagcctcctgaagtgctgggattacaggcctgagccaccaagcctggcctggtttatttggtcttaatgcttatttttccccagtattaccttcattctgattttttttttttaactttttttttttttttttttgagacagttttactcttgtcgcccagggtggagtgcaatggtgcaatctcggctcactgcaacctccgcctcccaggtacaagcaattatcctgcctcagcctcctgagtagctgggattccaggcatgcgccaccacacctgctaattttgtatttttagtagagacaaggtttctccatgttgggcaggctggtctcgaactcccggcctcaagtgatccacccgccgcggcctcccaaagattacaggcgtgagccaccacgcctggccaattttgtgtgtgtgtgtgtgtgtatttttttttttttttttttttttgagatggagtcttgctctgttgctcaggctggagtgcaatggcgtgatctctgttcactgcaacctctgcctccagggcttaagtgattctcctgcctcagcctcccgaggagctgggattacaggtgcgtgccaccacgcccagctaattttttaaaaaatttttagtagagacagcgtttcaccatgttggccaggctggtctcgacctcctgaccttgtgatcagctgacctcggcctctcaaggtgctggaattacaagcgtgagccaccaaacctggcctttattacattttaaaacaatttggtgatgtatagattgaaggttaatattttgattatgtaaattctgaaagtatctctggtattaaatggatagttctgaaaattatggaaaataaactcatctggtgcggaagagtagagacagaaaagacaggaatcacttaaattgatagtgttcaggaattacttctcatttccacttgcattagtaagtagcccagttttctgattggcttagtgggcttaattgtgtttcttgtgcccttctattctgtgctaatcttcagaacaatccattgaggaaaatagcatctgtgatgatagttcatgtttacacaggggaaaacttcagatttaaaaggctgaagtgatgttcccaaggtcatatacaagtatcatttatagccgttccacgatggctcacgcctgtaatcctagcactttgggaggatgaggcaggagaatcgcttgaacctgggaggtggaggttgcagtgagtcgagattgtgcaactgcactccagcctgggggacagagtgagactctgtctcaaaaacaaactacaagtagcatttaaagttcagcaatctcgactcactgcaacctccaccaaaagggtggggggagctggggactttcattctggttgacctctttagtttagtggttttgatatttaacttgttcacaaaatctacttttaaagaaaacctttttgcctgtatgtgtaactgaaaaatcagtaggtaactaagctttctggaggagagttatgcctagtttgtggaattacacagataaagtaatctgttgtaaagaatttaaaagcaggctgggcgagatggctcatgcctgtaatcccagcaccttgggaggcaggcagatcacctgaggttgggagtttgagaccagcctggtcagcatggtgaaaccctgtctctactaaaaatacaacacttagcctgtagtcccagcttctcgggaggctgaggcaggagaatcacttgaacccaagaggcagaggttgcagtgagccaaaatcgcgccactgcactccagcctgggcgacagagcgagactgcgtctcaaaaaaaaataataataaaataaaagaatttaaaagtaaattatctttgattcttcaagtttatctgcagtggtatttaattttttattgagatacagtttacatatgcagttcactatatattggcctgttctgaatatttcacacaagtggaatcataataagcagtctgaataatgctgctatgaatattcatgtttaagttttgtgtggacgtatgtttttgtttcttttggatatatacctaagcgtgagattgtggggcagtatagtagcaacattttgggtaattgccaaactgttttccaaattagccatgccattttacaatcccaccagcaatgtgtgagggttccaatttcagcacatccttagcaataatactgttaacatctgtctttgtgattacagctatcttagtggatatgaagtcttcatctccttgtggttttgatttgcatttccctcactgctaatgataatgttcatcttttcatgtgtttattggctatttgtaaatcttttttttacagaattccattaacataaaactatcttaattgttccaggtcataaggtaggcattctgttgctaccaactctttacagctaattcgtagctaccagcgaattacagcagaatagttatgaggaacacatttcccatctatcaccattctttttgttgttgtttgttttttgttttaagacagggtctcgctctgttgccctgtgtggagtgcagtggtgtggtcacggctcactgaagcctcggccttctgggctcaaatgatccgcctacctcccaaagtgctgggattacaggcatgagccaccatgcctggcctgttcttttttctgtgtaccaccttttccttattttattagacacatttgtttctgtcttagacaaaattgatagcttacatttattgagggctttactatgtgccagacacagtgttaaatgctctgcatgtattatttaagcttttgcaattacaggaaatgaagattctgttacttttacagatggggaaacggtgttttagtagctttaccaaggtcataattatcttgtgtttggagactatattaaaacaaattgtatacctttttttaaaagcttgttttgccgggtgtggcgctcatgcctgtaatcccagcactttgggaggccgaggtgagtggatcacgaggtcaggagatcgagaccatcctggctaacaaggtgaaaccccgtctctgctaaaaataccaaaaaattagccgggcatggtggcgggcacctgtagtcccagctactcaggaggctgaggcaggagaatggtgtgaacccaggaggcatagcttgcagtgagccgagatctcaccagtgcactccagcatgggcaacagagtgagactccgtctcaaaaaaaaaaaaaaaaaggcttgttttgttgttgacagccatgtctaaaaagaatatacgtttcctacctttgagtcttaaattcttcagtattaaatcactggcctctagtcttcagtccctgtggcttttataatttgttttaaaaattgatgactggttgggcatggtggctcatgcccgtaatcccagcactttgggaggccaatataggcggattgcttgagcccagaagttcgagaccagtctgggcaacatggcaaaacctggtctctacccaaaaaaaaaaaaattagctgggcttggtggcacacgcctgtggtcccagctacttaggaggctgaagtgggaggatctgttgagcccgggaggtccaggctgcagaagctacgttcatgccaccacactccagtctgggcaacagagcgagaccctgtctcataaaaaacaataaaaagaaaattgatgaccttctcttaaatttttctttttagcttaatgttttttatttatttttatttttagagacaggctctctctctgtactccaggctggagtatagtggtgccgtcatagctcattgcagcctcaaactctgggctcaagtgatcctcccgcgtcagcctcccaagtgagactacagggtctcactttcacccaggctggagcacggtggtacaatcatggctcacaccagcctcatccttcttgggctcaagcaatcctcccatctcagcctcccaagtagctgggaccacaggcatgcgccaccacgcctggctaatttttctgttttttgtagagaggaggtcttgctatgttgcccaggctagtcttgaactcctgggctcaaatgattggcctgtcttggcctcccaaagtgttggggttacagtcaggggccacaatccccatgctcagcccaggctattttttttttttttttaaacgagatgaagtctcactcagcctcccgagtagctgggacaacaggcacgtaccaccatgcccggctaattttttttgtatttttagcagagatggggtttaattatgttggccaggctggtcttgaactccttacctcgtgatctaccagcctcagcctcccaaagtgctgggatttcaggcgtgagccaccgtgcccagccccaggctagtttttaaaataaaattttagaaatgaggtattgctgtgttgcccaggctggtctggaactctaccacttgaaaatttttagcataaagcaattacattctcactcagaagtattgttttaagctaacactttcaaatggtagtagattcatcatttacaagttaaaaaaaaaacctaaaaaccggtgttaatagcatcagacagttcaggtagattttttaaaaggtgattcttaatataacaaaaatgctttgtaccttatcaagatagttttttacttatcactacttaatgtattaacatgcagtatcactgtgaaaattaaaagggctgtgagaattcggaaagtcaatgttgttttcttgtcagcaaagccaaaataatgtagtcatagtttctgaaataattaacttacattttaagtacatgataaattgatctttttgccagaaataggaaaaaaaaattcttgttaaaatgtgctgagcgctgaacattgttgcattgttagtgagaattgtatttggctatttcgtgacatttaaacactcttatattattgaaattttgcaggagaacgcccatataaatgtgaactttgtccttactcaagttctcagaagactcatctaactagacatatgcgtactcattcaggttggtaagaaattggaacttttctatcattttcagtaaatgaccattttaaggaaattcttttagacttgtaaccgagtcatttacttattatttatttttaatataatttagaagtcagaatttaaaaatcagtattccgtcaatctggggattcctaacatggaatccaaaggtggacctcctgaaaatggaatttttgtgtacactttttctgggaggaggggccttaattctcatcaaatctttgaagcgttccgtgactccaacaaaagttaaactaatgtagaccaagactgattgatcttttaacccctacttctcatatttctcctaacagtataaagctgagagtcacaacgtgtggttgacaagtgtcagggattccttcttagcttctcaggtcctgaaattaaggtttgttctgtttcaaggtttggtcgagcttttgaggactgactgcaaaagtttagcttgaaaaagaaaatgatagacaatctaggatgccaatttattaagctgtattaagagtataggactgtaacatgagagattcgtccactccagtgactgaaacaatcaccatcaccactcataattagtccctgttggccagcatggtggctcacgcccttaatcccagcactttgggaggccaaggtgggcggatcacctgaggcggggtagtttgagactagcctgaccaacatggagaaatcctgtctctactaaaaatacaaaattagccaggcgtggtggcgcatgcctgtaatcccagctgctcagtaggctgaggcaagagaattgcttgaactttaggaggcagaggttgtaagccgagatcacgccatcaagagcgaaactctatcttgaaaaaaaagtccctattgtcaaagtattcaagtggccaagttaaaaagtaatgttagcattggtggtcttgcttgaatgggtagccctgattgactcttggtgaactaccacttttactttttatttttatattttttttggagacggagtcttgctctgtcgtctaggctggagtgcagtagtgcgatctcagctcaccacaacctccgcttcccaggttcaagcgattctcctgcctcagcctcctgaatagctgggattacaggcgcgcaccaccatgcccggctgattcttgtatttttagtagagatggggtttcaccatgttggtcaggctggtctcgaactcctgacctcatgatccacccactttggcctcccaaagtactgggattacagtcatgagccaccatgcctggccgaactaccacttctaattagaatacagatttagaatgtatatccctgtgggaaaagtatcttaaatcttgctgttacaaaagcctatgtagaaccatctcccttaagttaataattagcttagatctgtgctattcgcttgagtagccactagccacatgtggctattaagctttcgaaacattagtagtttgaattgatacttataaaatatgtacttaccagattttttaaattttattttattattattttttttctgttgagacagagtcttgctgtatcccccaggctggagtgcagtggcgcgcatctcagctcactgcaacctctgcctccggggttcaagcaattctcatgcctcagcctccccagtagctgggattacaggcatgtgccaccatacccagctaatttttgtaattttagtagagatggggtttcgccatgttggtcagcttggtctcgaactcctggcctaaagtggtctgcgcatcttggcctcccaaagtgctgggattacaggtgtgagccaccgcgcccggccacagatttcaaacaatgtgaagaaaagactatctttctctgaagcaggttagagaaaaaataaaagaatgttaaatatttatttttcaagttgatcatatggcaaaattattgtatacattggctttaaaaagtaataaaattaattttaactgtttcctttttacctttgtggtatgactactagaaaatttaagattacatgtgtgatatgcattatatttctactggacattgctgccatgagttagtaacaagacttgataataagacttgattatgtcacagattctgatttatttgaacagctatgaaggtgtcctgtagtatagttgctagcctttcttgaccctacgtgcttgtcacgctaatgtactttgagtgtttttttcctaaatctaagccattgagtggtgccacttaaccagaaacctggttttattatttttgggtgttttttggtttcattctctgatggtaatgtggatgcaatttcagactttggaggtaagcatcatgtcctgttgatagttgtactagctttttagtaaaatatttgagagctttgtattattattattattattattattattattattattacttttttttttttttctgagatggagtttcgctcttgttgcccaggctggaataaaatggtgtgatcgcagctcactgcaacctccgtctcccaggttcaagcgattctcctgcctcaacctcccaagtagctgggattacaggcatgtgccaccacacccagctaattttgtatttttagtagagatgaggtttcaccatgttgaccagcctggtctcgaactcctgatgtcaggtgatccgcctgcctcagcctcccaacgtgctgggattacaggcgtgagccactgctcccggccaagagctttatattagttaactagtttttgtcttcataaatattttatgttgcatgagttctattatccccattttacagttggggaatgtagggcattgaaaaaaatacgaccttttttcctgtagaatgtccttccttctggatatgtccacttgttttctcatggtgtcatttagcttttcttctgtcctttgtattgtaaactggaaattaaatttaaatgcttgataatctttctcgcaaatgatatgcctcatttaaagtcacgtggttgacccattaatataatgttaggtcactgcatttagaatgactacatacttttatcctttcgttcaattagtaatactttgtcttgtcactgtttaaatgtttatggtgttttacaccagttgataatctttgactgaaacagttgtatttgggtttgcaaaatgttttgagttttgcctgctgtattttaaagatgatttttagtatttgctgttacagtatagcaagtattttaatggtgtcttaaaaactagtagtagccactagctattgtatgtatgctgaatagtaaaaacaagtatttgctgtctccagtcttagtactacgaagatactgagtttcagattacatattataggatacaagctcacaaataagtaattttgttgttgttgtttttggagttggggactctgctgcgcaggctggaatgcagtgatgcgatcatgcctcactgcaacttcatatgcctaggctcaagccatcctcttgcctcagtctcctgagtcgctaggtctactggcacatgccaccactccagctaattggggactattattattattattatttttgagacagtttcgctcttgtcacccagctagagtacaatggtgcgatctcggctcactgcaacttctacctcccgggttcaagctatagaatcttcctcagcctcctgtgtagctgaaattacaggcacccgccaccatgcctggctgatttttgtatttttagtagaggtgttgatccacccacctcagcctcccaaagtgctggaattacaggcatgagtcaccgcgcctggctggaactattatttttatttaaatatcgtatttatttatttattgagactgagtcttgctgtcgcccaggctggagtgcaatggtgcgacctcggctcactgcaacctccacctcctaggttcaagcgattctcctgcctcagcctccctagtatctgggactacaggctcgtgccaccatgccaggctaattttttgtatttttagtagagacggggtttcaccatgttagccaggatagtcttgatctcctgacctcatgatctgcccgcctcagcctcccaaagtgctgggattacaggcgtgagccaccacacccggccaatatcctatttctttctatggagactgggtcttgctgtgttgcccaggctggcctcaaactcctggcctcaagcagttctcttgtctcagcctcccaaagtgttgggattacaggtttgagtcactgtgcccagacagacatgttttatttttttctgttgataacgttggtgccaagggacttttaaatagctgggattgtttgaaagatattgtgatggcttgagagtctttgtagaataaattttaaaaactattttattgagatataatttataaatttaaaaatgcacaggtcttgagtgtacagctcagtgactatgctttcacctatttgattatcactcaagaacaagagatggaatatttctgctcagaaacaccttgccctttccacccagtctttcccctggatgatattctgtctcctaccaaagaacattatagaatttgtttgtttgaggtgggatctcactctgtcactcagggtggagtgcagtgggtgcagttacagctgtctaaacctcttgggctcaggcagtcctgccaccttaacctcccaagtagctgggaccacaggtgtgcgctaccatgcctgttttttttttttctttcttttttgtagagatggagtcttactatgttggcccaggctggttttgaactcctgggctcaagcgatccacttgcctcaccctaccaaagtgctaggagtacaggcatgagccactgcacctagttttagaacattcttttataaaatgttcttgagatttatccatgttgcgttattggacttcattttattgctggtaatgtattgtatgccgccattactttttacttaaaaattttctttgccggctatgcacggttgttcacacctgtaatcctagcgctttgggaaaccatggtgagcggatcatcggaggtcagaagttcaagaccaggctggccaacatggtggtaccccatctctgctaaaatacaaaaattagcctggcatgatggcgggtgcctgtaatcccagctactccggaggctgagacaggagaatcacttgaacccgggagacggtggttgcagtgagccgagattgcgccattgcactccagcctgggcagctgagcgagactcagtctcaaaaaaaaaaaaaaaaaaaatttctttgccattctctcttggtttttgttttgttttgtttttatttttaagggaattaatttaaaaacttaaattgagaggcttgtatttgtgtatttttcactgcggctttaacctcctaggctcaaacgatcctcccacctcagcctctggagtaggtggcactgtaggcttgtgctataacatgtggctaatttaaaaatttttttgtacacagggtctcactaggttgcccagactggtctcaacctccttagctcaagcaatcttcctcacctcatcctcccaaaagtgctaggattacgggtgtgaaccactatgcctggccattcttctaagaatatttttgatacgtatgtgtaaagcttgcagaactctttccccttttgtcttggcttacacctataaattcatttcggaggcataaaacagacaattggtagatttataaagaagagaacctgttactagaattgggaaaaagaatttaaaattgtttgtacagggcaaaagttaatattcaggtaggtactaattagaaaatcttgatgaatatattttaatataagcaagacttcatggcaataaagtaaaaattacgggagaaaaagaacggagcaaataaatcatgccatcaaattttaaacagaaaatttctacatcctccctttccgttcaccattccttaggtggaccctcgcaccttgatggatgcatgcttgctctatagatctccttattcatcagagttataaaatggtgctattttaattataattattttattagtgtgtaaatatgaagagaagagataaattccacttatctatttactcatgatgtaggaaagacaggatacgtaagagtcttccccttgattgatcgattgattgagatggagtctcaccctgtcgtccaggctggagtgcaatggcacgatttcagctcactgtaacctccgcctcctgggttcaagtgattctcctgcctcagcctcccgagtagctgggattacaggcatgcaccaccacgcctggctaagtttttgtatctttagtagagatggggtttcaccatattggccagactggtctccagctcctggtctccaactcctgacctcttgattcgcctgcctcggcttcccaaagtgctgggattacaggcgtgagccactgcgcccagccttttttatttatttatttttttgagatggagtcttgctctgttgcccaggctggagtgcagtagtgcgatctcggctcactgcaccctctgcctcccgggttcaagggattctcctgcctcagcctcccaagtagctgggactataggcacacatcaccacgcctagctaatttttttgtatttttacaaaatgcctccccaaattttatatttttacaaaaatgcctcccaaagttttgggactacaggcgtgacccaccgcgccctgctgagtcttcccttttatttatccatactcaaagttaccaattggttccaaaagtgaacaattataggtaacacattttgagttcttgctgtctgctccatgttaaggactttacatagattagattatttatagctcacaacacttagagagtattttatagatgaaattgaggccgggcgcggtggctcacgcctgtaatcccagcactttgggaggccgaggagggtggatcacctgagatcaggagttcgagaccagcctgatcaacatggagaaatgccgtctctactaaaaatacaaaattagccaggcttagtggcacatgcctgtaatcccagctactagggaaggtgaggcaggagaatcgcttgaacctgggaggcgggggttgcagtgagccgagatcgcgccattgcactccagactgggcaacaagagtgaaactccatctcaagaaaaaaaaaaaaagaaagaaattgaactctagagaggtttcaggactttgctcaaagtctcagagtgagcaacttgcagagctcatgttttatctcccagatggtctagctctatctagaagttcttaggccttatgctacctatctttctacattctatgtccacgtatgttaaaatgtttgtctccatttaaatcattcactggagagaaccaggtatagagtaatgtagcatgttgtagaaacttgcatatttgtaaatctgttagtagaccaacatggagaagaattgtccagtcagctgaatatctaatttgactacctggataaggtgattattttatcaccaggcattttctaatcatgtaaaacttaacatctacatggttttacctaatgtctgagttttgctttatgaaaatttttagtacaatttgatatgaatttgagaatgtttgagatgaattttcataaatgtcaatttccgtttttctactatgcattccattggaccagtggggtatggataccatttggtaatatttactagagtgtgatctagatgggtatgtattcaggtagaatgtattactcttatgcctttaatttgggggtgggggttctggttttttatgtatcagtgattgtgactttgcttattttacataccatatctatttgtgtgccacttctcattacctagttcctttatgtattttatagaaaggtggggggaaaatcaagaaagttttctgaataagtaccttggcctatatttttgctttaaaatagcaatgctagcgcaggaagtttgctaagtagaaatattactctgctctagccgtgacagacagaaggagttgatttcaggatgagcctttgctcagactagagcagaatttcaaaacttttgcaccgaggatttgggtaggacggccagagtgagagatattgttcgcgctattgagcacacgaacttttgggtgggtgtggtttaggcctttcctcgtctgtaatgtggtttttgatgtgaggctcgccatgaggctcctgtctattgtgcatcnnnnnnnnnnnnnnnnnnnntaaatttcaagaaaaagcctttgctcagactaaagcagaatttcaaaacttttgcacctaggatctgggagtatcgcccagagtgaaagatatttttctcaagatttaccataagaaatttagggtggagggagtatgggaattttattttatttttatttatttttgagacgaagtttcgctcttgtcgcccaggctgtagtgcagtggtgcgatcttggctcactgtaatcttgccttctgggttcaagcaattctccttcttcagcctcctgagtagctgggattacaggcatctgccactacacccggctaattttttgtatttttagtagaaacagggtttcaccatgttggccaggctggtcttgaactcctgacctcaggtgatccactgccttcgcctcccaaagtgctgggattacaggtgtgagccaccacacctggctgggaattttatttattgatgtatttttgagacagggccttgccctgttgcccaggttggagtacagtaacacattcacaactccatgctacttcagattcctgggcttaagtggtcctcccgcctttgcctcccaagtagctgggactgcaggtgcactccaccatgcctggctaatttttttttttttttctttttgtgagacaaagtcttactgtcgcccaggctgaagtgaagtggtgggatctcagctgactgcaacctccgcctcctgagttaaagcaattctcgtgtctcagcctccctagtaggtgggattactggcatgcaacaccacgcccagctaaatttttttatatttttagtagagatggggttttactatgttggccaggcttgccttgaactcctgacctcaggtgatccacctgccttggcctcccaaagtgctgggatttacaggtgtgagctaccgcacctggctgggaattttatgtattgatttatttttgagacagggccttgctctgttgcccaggttggagttcagtagcacattcacaactcactgctacttcaaattcctgggcttaagcggtcctcccgcctttgcctcccgagtagctaggactacaggtgcactccactatgcctggctaattttttttttttttttttctttgagacacagtctcgctgtcacctaggctggagtgaagtagtgcgatctcagctcactgcaacctctgcctcctgggttaaagcaattctcgtgtctcagcctcctgaataggtgggattactggtgtgcaacaccacgcccagctaattttttttgtatttttagtagagatggggtttcaccgtgttggccaggctggtttcaaactcctggcctcaaggtatccgcccaccttggcctcccaaagttaattttgttttgatttattttgctcaggttgttctctaattcctgggctcaagcagtccttctgccatggcctcccagagagttgaggttatagttgtgagccactgcacctggccagaattttattttctactccattaggcatttaactaaacacacaaaaaaatttttaagttgataatattcctccaaattaacatccagagcccaattgaactttgccaatatgtgtatgtcttaaagaatctctgttctttagtagtgcttgaggactctaacttgaacttttttgaagcttgtggttaactgagatttattcctctcttttgagaatcaatgtcaagggatagagaaatgttatacaaataaatatggtaaatgtaaggtgcatgatacagcattttaaatagtctttgttgttactttacatatacagttctttatattttaatcttgaatttgtcttaatctatgtcttctctcatacttttgatttgccttcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagattttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaaccatgatgcctttgtttattattggtatatccagaatgtaggaaagccaaatttatgttgctggaactgcaagtgtattaataggcttttgaagattatttctcaggctgggcgcagtggctcacgcctgtaatcccagcactttgggaggctgaggcaggtggatcatgaggtcaggatttcaaggccagcctggccgacatagtgaaaccacgtctctactaaaaatacaaaaattagctgcgtgtggtggcaggcgcctgtaatcccagctactcgggaggctgaggcaagagaatcgcttgaacacaggaggtggaggttgcagtgagccgagatcgtgccattgcacttcagcccaggcgagagtgtgagactctgtctttaaaaaaaaaaaaaaaaaaagtatcacaggtagaaaagtcacagcatgttgtctgaggtaacagtccagtatgggtagtaacccaaagcatacactgcttgatgggaggtgcgggagaaattggacaattcacacaagattttaaatagtaattacttcccaaccacaagtccccttaatagttttcatatgcatatcccttttcagtagcaggcctggaattagtgaattttgattcatgaagatgttttattttatgtatttatttttttttgaaacagtctctgtcgcccaggctggagtgcagtgtcatgatcctagctcactgcaacctctgctgcccgggttcaagcaactctcctgccccagcctcgcaagtagctgggatcacaggcgcccaccaccgcgcctggccaatttttgtatttctagtagagacggggtttcaccacgttggccaggatg

SEQ ID NO: 14488 - DNA, 12360 bp, Human
  misc_feature (1)...(12360): n = A,T,C or G
gaatttattttagatttttttcgcttcctttttgtctttaaactggtagaagacctggtttaaaaaagcacagtggtatcatgtatttgcaagtaaatacattgttttacaaagctagagtattgtgcacaaagtagatactcacatgctcagtttgtgcttctcaggatgcaatcagtgtgacttagttttctccctttttttggagatgtatgtgactttcaataattcttaataggactttctttgggcagataacactgtgcccccacatgggaattttagaaattgagcttctttatgcttttgcttggctaagaagaaggggctttaggaaaggaaaaacagtagatatgttacatgagtattttctgctaaaaaaaaaatgggttcaaaagtggtacagatatgtttctgaggtttcatgattgccttacagagtcactacaggcatacctcattttattgtgctttactttattacactttgtaagtttttcacatattgaaggtttgtggcaactctgtgttgagcatatctgttggctcctttttttttttttttttttttaagatggagtctcgctctcttgcccaggctggagtgcagtggtgggatctcagctcactgcaacctcccaggttcaagcagtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgaatcacgaggtcagaagatcgagaccatcctggctaacacggtgaaaccccatctctactaaaaatacaaaaaaaaaaaaattagccaggcatggtggcgggcacctgtagtcccagctactcgggagactgaggcaggagaatggcgtgaacccgtgaggcggagctggtagtgagctgagactgtgccactgctctccagcctgggtgacagagcgagactccatctcaaaaaaaaaaaaggtatgtacttgttttcagacataatgctgttgcacacttaatagacaacaatatagtgtaaacatagcttttatatgcactgggaaaccaaaaaatctgtgactccttctattgtaatatttgctttattgcggtagtctggaaccaaacacgaaatatctccaagatatttctgtattttgaagaggagtgagttactttttatttatcatctaaattctagagggcatagcttgtagaaattgccaagttaggtatttttgtagtcctaatacacttcaatttgtgctgtccctttttttccttcaaaaagctcaaaacaagcaattaatagtggaaaaataaaacaaatcttgttctccatttctttaaagcagttcacttgttaagcctttttatacctaggaagcctcctttgagaaggctttaaaaggagtgggggtagattctgggataactatatgtacatgagtagatttgaattgcagagattcaaaaagagtagatttgaattacttctgtgaatcaggataaatttatatgcatcttattagcttaggcaccccaatcaggtagatagattcaagctctcctgctgtatctatataaagttaatagaaaaaggaataagttgaaatctgagattctgttaatgatagataaacttttctttgttaggaccaaaatgtctttgactccaagaagaaagtgaaattaaccaatgcggaaggagtagagtttaagctttccaagaaacaactacaagctatagaatttaacaaagctttacttgctatgtacacaaaccaggtgggtaattacctttggtgtcatggctaaaccttttgtaatatggtatatgaggagtaatagggatattagtctaatctttttatagtttttgtttgtattttgtcttcaactcataaatatatttttttgccttcctcaaaatattatatatattattggctgggcacaatggctcatgcctgtaatcctagcactttgggaggttgaagtgggcggaatgcctgagttcaagagttcgagaccagcctgagcaacatggtgaaaccctgtctctacatggtggtgtatgcctgtagtcccagctactctggagactgaggcacaagaattgtttgcagtgagctgagattgtgccacttcactccagcctgggcaacagagagagactgtctccaaaaagaaaaaaaaaaaagaaagaatattatgtgtcatagattttatttattaaacaagtaatttgcccaatttcttataagggtgtagggttgacaccttttaaggggaagaaaacagtattcacacctttaaatgagataactttctcattaccttatttctaatctgaattaagataaaatcatcaaagatgctagccatgattatagatttaagacccatctttcatttttgctgtgtataatcacatcaagttataaatgttaaggaagtcaattctaactccagtaagcattctaattctaattttatactgttttagagcagaagttttagtgggagacagagaagcagtaatttttttttttttttttttttttttgagatggagtctcgctctgtcgcccaggctggagtgcagtggtgccatctcggctcgctgcaacctctgcctcctgggttcacgctattctcctgcctcaccctcccgagtagctgggactacaggcgcccagcaccacgcctggctaatttacttgtatttttagtagagacggggtttcaccatgttagccaggatggtcttgatctcctgacctcgtgatctgcccacctcagcctctcaaagtcctgggattacaggcatgagccaccacgcccggccgagagacagtaatgtttttattatttagaactgagtcaagttattcttaataatgtagcaaaaaatacatatatgcattttgttgtttttgaagcaaatgcttatatttgatgtgtttgatttttttaaacagttctagaatttaggcatccaagtgaatgtttagaatttctcctttactaaagactcttagagctcatagattaaattcaataaatggaaaccattttcttacaagaaaaaattgagaatagatactgtaaactgattctcttaccctaggcagttctttggttaatatttgtttcaactgattttcccatgtttcttttctttctggtcatttagtgtttaatttcattaaccagtttatttttcttgtgggggttggatatcttctaggctgaacaatgccgcaaaatatctgccagtttacagtcccaaagtcccgagcatctcttacctgtgttaatccaagctgcccagctctgccgtgaaaagcagcacacaaaagcaatagagctgcttcaggtaaaataattacttgaatgaggtgtcagacatttgcagctttgtttcattttcattgtgttgtaataacctactagcatgtaaatttaatgggaaaactaatcagaaatgtaccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaattatggagatactgactttgtttttatcaacccaaaccagctattatattgcatatttaaatttcttgaatataaactacattggaaagttggacaggtacaattaggatcatcctgacagacaaaattgcctaacagggacactcagtgaagagacaccgccccttctctccccacagcaaaaaaaaaaaaaaaaaaaaatctatttagtaatctttattatagttgaccctttgtattcttgagttttgcatccaagaattcaaccagccatggattaaaaacattttgtgggggtcgccaggcgtagtggctgacgtctgtaatcccagcactttgggaggcccaatcaggcagatcatctgaggtcaggagttcaagaccagcctggccaacatgttgaaaccccatctctactaaaaatacaaaaaattagcctggcatggtggcgcattcctgtaattccaactacgtgggaggctgaggcaggagaatcacttgaacctggcaggcggagttgcagtgagccgagatcacgccactgcactccagcctgggtgacagagcaagactccgcctcagaaaaaaaaagcacattttgaggttggaaatgtatgactgcctctgtactgaacatatacaaactttaaaaatcattactccctagataatataacaactatacacataggatttacattgtattaggtattataagtaacctagcaatgatttaaaatgtataggagcatgtatgtaggttatacgcaaatactatacttttatataagggacttgagcatccttgggttttggaatcgggggtggttctggaagtaataccctgtggctgagggatgatggatttctctgttagtgacttacagaaaacttgacttcattgcacttacttttagagcatacctttaagaaaaaaagtgagtgttgaataaaaatttccccaagttaagattttgacctgcagccagaagtttaatgttttaaaactggatttaaaatcttatgtagctaagtaattgtaatgtatacaattagttgtgtaaattaaatgtgatttttttcccccaaactaaaaaaatttaggaattttcagatcagcatccagaaaatgcagctgaaattaagctgaccatggcacagttgaaaatttctcaaggtattatggttttcatcatgattaaaatattttaatgaaaacatgtttggaatgattaagcagttgtgaactatgtgattttaagtttttttgtgtaatagtaaagcataataattactgtttcaaacatgcagctagattgtatgatctccaacagatttagtagtgaggtagttgccccttttcgtggattattcctaaattattagaatgattcttaatctatgccttgaaagttctgaagcaaaggattcctctcttccaaaagaccatacatactactcaaattgcctgagtatgtcacatgcagaaatgcttatgtccgtcacttggtaatatttgtacgactactttgcatcatagttttcagaatttcttagcttggcccttcatccttacttcattttacactttgccacctatgtctttgggcttggggaaaggtaatagaatttaacgagaactgatgtgtttgaatcttaaaactgccaatgtttttgtctgtggttttcatctaactttgaatatctagagccatgttgcccagtttggtagtcactagccacatacagctattttaagtttaaattagttaaatgaaattttaaattcagttctttgattatgctagccacatcttagaagcttagtagctatatgcagccattggctacaatattggacagcacagatataggacatttatatcatcacaaaaagttctgtcgaacagctctggtatagaatgtggattttcaatggtggtgacaattcttcacaaaaatcttaaatattacagtggctgaaatgaaaattttatgagttgaaggaggggagttggcagttagggaaaaaatgtttaaaatgtccttagtagggcaataatgaaaataaggttgagacacactgctgatctccctcttatccaattctcacatttctttgctttccttgtctctttttccttctcctcagccctgtcttctcttccttgccctttacttgatctttcctcctatgtttagtttattttttcaaggattatttattatcttgaaattactgacaatctgtcatggttttttgtttgtttttaaagactgggaattttgagttattgaggtttgcagtgaatacaaaatcagaatttaacaccataggaaattttccattgcactcatgtctacagtaacatatttcaaggcctttagggaaggacccccaccttcaagttacagcccaaaaaagaagaaatagaactcaacagactgggagctgggagacttcttttctggtagcagctctgccattaactttctttgtgagcttaagcaaggtatattatttctttagaactcaatttccttatctctaaatgaacagagttcaccatccccaagaccccaaagtttatatgtttagcgatgttacaaaacatgagttatggttgctttcctaaggaaaagtagtgggaggaagtaaaatttcttgtatttttttttcataatatgtgttcttctatgtaatgctgattttgtttattctcctaaggtaatatttctaaagcatgtctaatattgagaagcatagaggagttaaagcataaaccaggcatggtgagttttaaaaattacaaaattgaaaagtagttgaattgataatttgtatgtctaatgtgtattcactttatttatatgtcgaatgtgtattcactttaaggtaggagtagtaattataatagtaatagttgtctggtataaatttaatttcattctctgctctggtattggtttcttattcagtcaaatgtgccaggcactatttaggccttatagtatcactgaaaaccaacctcaaataatctcagatctgtataggaatttcttagcctatatcattttcgtcagtgtgatttctttaaattagaacaatttcataattgtggccaacaaatttagtttttagttttctgattattcaaatattgcaggtttcaatcattaatacagctgtgaaagcatcttttccatagtagaaactaattctgtagtggtagtatgtgcatcttttggacaggggctgttttattcatgtttgcattctcatggcctctgtgcagttggcactcagtaaatgtaatatggtagtgctttcccttaaagattcatattttaaggatcgtgctataattactttaccttagagtcaaatacagtatatgactgaaaataaaatgtttctaatatttaatatatgaccaccttttacctttcaaggaatgtatccatttcatttaggttgctgactttattggcataaaagttcttcattttatttctttattgtccttttaatatctatagaacctctctcattcctgatattggttattcatgtatttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgcattagttaccatgtatagccatgaagaagatattgatagtgccattgaggtcttcacacaagctatccagtggtatcaaaaccatcaggtaaataaatggagtaaaatgttatgagagcatgtttttacataaaaataaagatggagtagtgaaaaaattcaggcaaacaagtattacacgtcactattttaaaagtggaatactatttagattatcaaatgcatttttttagtataccagatccaaattaagttattagaaataagcaatggctgcaaaatagaaaaatagcacatttatatttattgaagctccttgctgtatgtgtacatgcatttgtgtatgtaatctcaagaaataataatagtacatgattgcatatttaagagatcgtcttaaatggctagagagcccatgggtggtagtaattagtacaacagtaatacatggaatagttgtttatcatgtctctatctagtaggaatatcttaatttccagtatggatctctgcatgggcagtatccaacttaaaattatacatacgctgtgcaggtggcatttatactgttagtactgttagcagtggaggggtatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttcctctacatgtgtggatgattttgttgtttcaggcattcagtgaaacttaagatgagggatctaatgcataggtgtatttcttaaaggtctaatgaatataactgcatgcacttgctagatatttaacttgaaactttttttttctttttattgaaactgtagccaaaatctcctgctcatttgtccttgataagagaagctgcaaacttcaaactcaaatatgggcggaagaaggaggcaattagtgacctacaacagctgtggaagtaagctctgaaacgtggagttgtagaaataacacatttattgttgctacttgatatgagggagttacttgtttatattactttctccagttttataaacagttcaataattttcttatttcttcttttagacaaaatccaaaagatattcacaccctggcacagcttatttctgcttactcacttgtagatccagagaaagccaaagcgtatccttttgattgttattccttacagctcctcagtagcacaatagatctcttctgatatctgtgttttgaccagagctttttcaattgtaaactgcaactaacaaatcctccttttaactagtaaaaccaaaaaatgagaatttattgatcagtgtgactgaaaaatgcggcgatagatccaacttagggttcagtttcatccagaagcaaaaatgaagtcaaaagggtatggcctcttttcctccaggttcaagatcagcagcaaggtaaagaaaaagcatattttatgtgggtacttttgcatgattctgaaatgttattttcagattcaactacttaggtcacttgcttatctcaaatagttacctgataagcgaatttggtgcccttattgagcttggatcatatgtgctactctaaatcagagtgtgttcccaaaactgaggtgggttggtggatgctaagcagtcacaagtcataaacttgatagttgttttggaatagagtttgtattaagccaccaccttgctccacatcactgtgttaaggaatagagaattagattatgactcctcatgttctcctttcagaatactgtatgtactatataattgatatgacttgttattgtatagaagatttaggaacattttttgcttttgttgaaggtcatcaagaaaagacagtcttccagtgtcaatagatacattggcaaacatatatatctatataaatgtgtgtgtttgtgtatattatgttcctgaactcctgttctatcacagtcttagtaaacacttgccatcgtcagatagtatgtctctaaaagtagatgttgaggctcttgaaaattctgctggtgctacatacattcggaagaagggtggaaaagttactggagatagtcaaccaaaggaacaagggtaatatttttcattgtaacgttctctaatgctgattttaaattagacaaggaataaaaaatacattctcatagaaatttcatgtgaataaagttctagttctctttgttccttttccatttctctcactgtgcccagctctttgtccttatttccttcccttttccctcagcccaaaattaacctctggtattaatttaatctattattccagaagtttttctttgtgtttacacacacagatggtttacaaatattttctttaaattggtttatttattactattttttttttatttgtttgtttgttgagacagagtcttgctctgtctcccaggctggagtacagtggcacagtcttggctcagtgcagcctccgcctcccgggttcaagcaattctgcctcagcctcccgagtagctgggactacaggctaatttttgtgcatttagtagagacagggtttcacccttttgaccaggttcgtcttgaactcctgacctcaagtgatctgcccacctcggcctcccaaagtgctgggcaccacgcccagttattttttacagaaggaggattgtattgtacttagtgtttcccaacttacttttatttaatgagttttagagatctttccacgtactaaaatgtggacctatttcatcctttttatgcataacactccataggctggatgtgccttcctttaccttttagttattgttgtacatttagtacatcatttagtatatgatttcttttgctgatttgaagaaaaggttagtcggcttcatctacttaaaagaagtcagattttgacttgtttcttccatcgtcatcttaaaaatatagttagcagagacctacagtaaaatgttttaagattttacttttgactcaggatgaatagagcatggaaaagataaaacatttccttagctttgtgacttttataagtttttgctacttcctccttttttgaatgccttttgaaatctaaatttttccctaacttaaaaaaaactcagcaacaatgactgatttctttctaacaaactctgcatttcataaaaagcattgttgttctcataataacttccaaaacttttaataaggaattggagtctcaaagaggttacattgttccgaattccatttcatcttacaattataaattcagtctgggttcttaaatggattttcaattaaagtatgtttactatttttttcttccccaaacagggttgagtaactactaaggacacgcagttccttctttagcctggcatagtggctctgtgttccagttactgggaggctgaggcgggatgattgcctgagcccaggagtttgaggctccagtgagcagtgattgcatcactgcaccccagcctgagtgacagagcaagacccccatctctaaaaataataagtttttaaaagtttttttaaataatctttgtttcttttgtttgtttgttttcttttttgagacggagtcttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagtagctgggactacaggtgcctgccatcacgcctggctaatttttgtatttttagtagacagggtttcaccatgtcgatcaggctggtacttgaactcctgacctcaggtgatccacccgcctcagcctcccaaagtgctgggattacaggcatgagccaccaagcctggcttgctttctcttttttgcttagacaatcattaagatatacattgactttttaagcttttaagtttcagcacagtattttcattatgcattattaatgctctttattttatcttattagaagttagtattttgttatactaacttggatgcaaaggtttagtttcctttaacaatacactatgtgataggtttatgctaggtgttgaccagaaaataaatcatggtacttgct

SEQ ID NO: 14489 - DNA, 83218 bp, Human
  misc_feature (1)...(83218): n = A,T,C or G
gatcatggaaccaatttagtggctcttgaccagtgaattaataaaaaggaaatcagggccgggcatagtggctcacacctgtaatcccaacactttcggaggccgaggcaggtggatcacttgaggtcaggagtttgagaccagcctgggcaacatggtgaaaccctgtctctagtaaaaatacaaaaattagccgggcatgttggtgcatgcctgtaataccagctactcgggaggctgaggcagaaggattgtttgaagctgggaggcagaggttgcagtgagccaaaatctcaccactgcactccagactaggcgacacagggagacttcatctcaaaaaaataaaaaaaagaaaaagaaagaaaagaaaagaaagaaagaaagaaattaaatacaataggaaatagagtgcactctgcatttgtttccttttcaagaaaacaaatgggtcatgtaaactgcatctcttaggatggaacaaagacaaaaatatttagggaaactctgctgtaaagatttttcattgttttttaaacaactgtcaggtcaacatatgacctttgaggggaaaaaaaatgctccacttgtctataatacactaaggagaggccaaaaagcagtgctaggtttttctggattggaggatgtttccccactctccaccccccgattttgtggtcatttaattttcaaaaaatttgcaataattatccttgtaagagtctgttgagaatgagttctttacactgctaatgggattatgaactgaactgctggctttcagtcagcaaccctgtaaatccctggatttatgctaagaaaaaagaacacaaaagaaccacaatgtgacatgcagaataatgcacgctgcaatgttacacattcagttaaaaagtgaaagcaacttccatgtctgcattggagaggccagtgctcctgggaagagaggctttcaagttgagtttgcagagcacttcgcagaaagactgaggaagagtccaccgtttatatcaaaaacctcctggaatgctggtgaagactgggggcgctttaggtgcctccgtggcagctccaacgaggaaggagctgggacccctgctcctctcagctgcgctctgttctcccgagaggcttgctggagggcgagcagttcagcaagaactcaaaacaacggcacagctctcacacggattccagtactcactgaaaacggctcagcacaaaaaaagcacagagtcttgttgaatgccactgggagacaaagcggggagggaggtgcaggcagttaagaggttccagaaagggaagtggttggcaacggtttgtccttttagtgcttgacacccaagaccacagcaggcctgtggccagcggggacacagtccacaagtgggggtttttaacagcttgttcttaagagagcttcccaaaccacagagtaatgagcactcaggtgtctcaggcccacggaggatttaatagatgaaaccctggatcgtctcgaagccgtggttgttaagaagtttaaatatattgaccggaaacggggagaaaccagagggtggaagagccgctcgcactgcggtgcgatccctgagggctcggggcaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcgggggtggcggcgccggcagggggtactgcgcgccgggcatggaagtgcgtgaagagccgcaagtaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtgggcacgagcgcttccctctccaaccctgcgccgctcggcccagcgaagggcacatccgacggggcgtccgcggcggcctcgccccgcgctgctcactgcgattcccccgcgggcatcccaggagccagatgggagggaaagagttggcagccgcggaatgccaggagcggtgggcgacgcccccccttctcctttttggtggttttattttgagagtttgctgcgtgcgtccagaaagtgagggccgggtgtatatgtagaaaagattttccgagacctcagacttccccatgcccaaagcgcacccaactcgtgctaacatctgtccatttctcatcattcttggcttggggatgtagagagaggtgaagtcaagagatgggggaaaggagtttgacaattaaatataaagtaaggacttccagacagacttttttttttaaaagataggatcttgctctgtcgcctagggtggagggcagtggcacgatcttggcccactgcaacctctgcctcaagcgatcctcctgcctcagcctcccaagtagctgggactataagcctgtgccaccacgcctggccaatttttgtttttttgttttgttttgttttgttttatagcgacggagtttcactatgttgcctaggctggtctcgaactcctgagctcaagtaatcccggcctgctgggattacaggcataaaccaccgtgcacagccctgatttcttagtattgaagaaaatagtccactttctaaaaattataggttctcaaacagtaatctaactagctaattatttgtgggcaaaaataaaatacaaactctttgaagactgtttttgtgatgcactttgttgtcaaccttctgaccattttgtttttccttcctatttctttgatttgtattgttttgcataatttgtccccaggatacactgttcagcagaaatgtctttgagattatgtttgattgtttattttattccaaacaagtccaagcttgctgtaaatgaaataaggaaataggccgggtgggttggctcatgtctgtaatcccagcactttgggaggccaagatgggcagatcacgaggtcaggagttcgagatcagcctgaccaacacggtgaaaccccatctctaataaaaaatatatatatatacattagctgggcatggtggtgcatgcctgtaatcacagctactcaggaggctgaggcaggagaatcgcttgaatctgggaggcggaggttgcagtgagccgagatcacatgacagcactccagcctgggtgacagacagagaccccatctcaaaaaaaaaagaaagaaagaaagaagaaaataaagtctggacttgcaaatacacgcacatacacacacacatagaaattttaactctaatgcctgaaataacattttccattggcagtattttcaagggaaagtcagacattcaatgttggcagctcctgatcttagccaaggtagaaaagggagaggaggcagttctgaggttacagaagctgttgcttctttaacacagttcagactttctccagaatttccaaattctttctttagagcttttcccagaagtccacaaactaataggttgtatgtcatcaatttcagagttcactattgaaagccttaaattgtgtaactcactagtaactatttatagtatcatcaccttaaacttagaaaattgcaacccaaaataatctgcatatgtttacaatagaaacagttatttgatactttggatcttatttgtcggtcacatcatgaaaagataaatgtgcgttatttaagaatttattccaaatattgagattttcttataaacattacaatggggaactttatagttttttcaaaatggcagatacttgccttatcagagcagaaggttagcttggtgattgttcaagtgttgtcaatttctagtttatacttaatattcctttttctcacctgctacttacatcaccaaacactcacacagtctgattataaaatattgagactgacagtcatatagaaccagtttcataacctcattaccatgtacacccagctcagtacctctccagactgcaaaccctttgagggttccggcctggcttttctttatatttggggaaatgttagagaaaacaacatctaaaactggaaaccttgacttaaattagccatttcttctcatcctaaattgagagagatgagttctaaatggcagagaccatttataggagaatgccaaagagagcagaagagaatgggaagcctttcccacagcagaaactttccacagcagagacaatagactgatccctatcacatcccctaaatatttcttctgacacctggatgggttttgacaatcatagaagcaaactggacagagtgccatttacttctgtgccatttcatactggggctttgcacagaataggaaatgcattgtctaggttcctctagacctctaggttcccttctattctcagaagaaacttaagttatgcttgagtataacttgagtaggggccaggtaggggcagcattgtgggattcagccacaatggtgtgattcaatctgccctctggtctttggttccatttaacgtgcatttattgagcagctaacttgagtcagcactgtactaggtgctatataccagggatgtacaaaacagatttgatgttgctgattaagaaagtatctgtacaagttacaaactcacctcccagagcacttgccctggagccctggagcttgccccagtcttcctcctttctaagatcaccacttacccaactgggaagagatcttggtctgcttgttttccatacctctctggtaggaggcaaagcgatctgcttgaaaatatgtctgaaagataatcagcaaataatttcaaatcttggaactgtcattatgaatttactgccattagattgtattgaggtccctgaagtcatggataaccagaagggggaatttgaagattccatttaataaaaagaagttgatacaaagaagctaagatatataataaaatttcatagttggaagagaacatgatgcttctgtattccaattactgattataccttttgttcatagtcttttaaatctgagctctttggcaatcccatttcagccgctttggtctcattaggtaccatcctttctccctcagaattaattttcacttctggaatcagaatgtcattcttaagggtctcccttattagtacctttaggaccaagttcaaactacctagcaggacataacaggcccttcacaatataactccattctattattttgacctcttctctccaacctcctttatgcactagccacagtaagtgtctgctattcacacttcagcacatatgtctctatgctttcatgcctctgtagaagttgtgccttctgcctgcaacgcctctcacctccacactcaccacaattgcaccctccttcacttcctttccatcctttgaactcttgcctatgatccttttgtagttcataagcatgatgattgagtgttcatacacatgtgtgaggtatgtcgcccccaaaccttttatgacattggcacattacctgtctgacatgaaagaaaaataataataaaaattttaaaaatgggcagccaggcgccatggctcacgcctgtaatcccagcactttgggaggccgaggcgggcggatcacgagatcaggagatcgagaccatcctggctaacacaatgaaacaccgtctctactaaaaatacagaaaattagccaggcgtggtggcgggcacctgtagtcccagctactcgggaggctgaggcaggagaatggtgtgaacctgggaggcagagcttgcagtgatccaagatagcaccactgcactcctgcctgggcaaaagagcaagactccatctcaaaaaaaaaaaaaaaaaaatttaaaaaatgggctgttacctagccttcaaggatcagctctgtcagtttctctgagaagcattctgactttcccccaccccaaaatgatgtatttgttcttctagagctatgcatccagccattgtttcaactaatatttattccacgtgtaccgtgtatctgtatataagaggcagtatagcagagaagttaagatgaggagctctcaagccagactcccttggtgtgaatcttgaccacttactaactatagccttgagcaagttatttgacctgtctgcccagggttttcctcacttataagacagggattataaccattatctatctcatagggttgtcatgaagattaaatgtcatgaatattatccatagaaagcgtggatgaacattaattcttgtcattattcaacatcaaagtaagctccaggtgggaagggagattttgctccctcatatagacagacccaaggacctagataagtgcatggtatgtagtatgttctttaaacacatgtctaatgcatgaatcaatgaatgaatcaacctatgaattggctaggcactctcctaatctcagggtaagtagccttgaataagatacacagaaacaaggaaacatattttcacacaatgtgtacatgctgtgaagggtgtacatcggagaaataggttagagactccagatgaatgagcagtattaagtgaggtgagtagagccatgctaagaacgcttgggaggatttcagcaaagggaacagcaaggccttgggccctgagtggagaacaagttggctactatagaccttccccaactgccacaaaagggctctttgaatgtctgtcttccccactagactgtaaccattgtaaaagagggatttcatcttataactccttataaacacagtgtctggctaataattgggcatatcataaatatttgttgattaacaaaggaatcctcttaagaaagcaccttcctgtttggaaatgcaggaaagcccctctcctgcctgtctgctctctttcctcctggcatcttctgccttcctaaagtctaggccagggaattcatctgacactgatttgccttcctttctgtcatcagcaatcctgaactctaatattggatggtaacttttccccccaaatcccaacatttccatatccccttgccgagtaaaattaggtccagagctatagaaactgttctgtaagtggaaaatgcttcagtatagattttgattttcaggtactcattttatttgatgagttttaaacctccattctttgagaagctcattttagattcattagactcattttttatgttgataatatatcatttaaatgtccatgttctactatccttcagtaaatgtatgaacttcattgaaagctgaaacaaaggggtttcaaattaaatgaagttgttaattgtctggtttatcttgggggagtgcaagtcagtgtaatacttcactaaactaacacagtagtaccatgaggactgtcagagagccagaggaggggacccaggtttgtggaggaaaagccaagaatcacttagtggaagaatgatgtcctgactgagacagggataagaaggaattgggtggagaagagctagcatagaggttgtggtagagttagaagggagatgagaagaaaacactgtatatatacaatagaatactattcagcctttaaaaagaaggaaactttgtcattgccacaacatgaggggacctggaaggcattatattaagtgaaaaaaaagccaagcacagaatgacaaatgctatgtgatctcacttatatgtggaatctaaaaaaagtcaaactcatagaagcagaaaatagaacagcagttaccagagatggggttgggaggaggggacaggattggcaagatgttggtcaaaggacacacaagtttggttagagaggagacataagctcaagagatctattgtccctcatgatgactataattaataacaatatattatatacctgaaaattgccagcctgggcaacatagtgagacctcgtctctataaaaaaaataaaaaaattagctgggtgtggtggcacacacctgtagtcccagctacttggtaggctgaggcgggaggattacttgagcccaggaggtcaaatctgcagtgagccatgatcataccactgcactccagcctgggtaacagggcaagaccctgcctcaaaaaaaaaaaaaaaaaaaagaaaagaaaaaaaaaaaagaaaagttctaagatcatagactttaaatgttgttaccacacacacaaagaagtgtatgaggtaatgcatatgttaaatagcctgatttagccattccaaaatgtctacatgcatcagaacatcatgttgtataccatatatatacaattttcagttatcagttaaaacaattttttaagagaaaggagataaccagagcatagccagcagaaggactcgcatgaggtttggtgggactgcctagggagaaggaggcagctggctgcgtgacagagcccagtgataggggagggcctgtgaccccttaaggagctgagacgctgtcacagagcaatgggagcgctgagtgatggagctggatttgtgcttttagaaaagctttgttggctgctgttgggagaatggattggaagggggtgagactgcagtcagagactcccataaggaagctgttactgtaatcacaacaacagatgcctacactccttcccaagacttccctctctgatcttagaagcattgtcaaatctgggttcccagcctgccatggcaagctgcttgctacttgggagtgaaaagcccttgtggagctttttcttattcggtgactgctcataaagtgccttcacctcgcttgccttattagccagtcctgcctccaaattaccaccacttgctcctttcaggagtctcttccccctaaagtccctattactccttctctctgctttcagatcagaaacagaaaaagtcaccttccctaagagtctgctccagtccagtagaaatgctttaaaatttttctggcctcagctgcccttcttgagcacagaaatttctagaatattgaatgaatcactggttctttataatcattttgtccagtttcaatcactgcattttaggaaagatttgaaaaactgaaggacaaagtggggccttagaggacttaggattctttcagaggaaagtaatctaaagaacaagttaatgtttcttcatcgtttgggaattagttattaaatggaagatgcctgaaaaattattctcttaatacagttcttcaggaggacagcattaaaaggcctggaattaaatagccacaaggcacatttagatgacacagcaggaagaactttccagtaaaaactattgaataggataccgtgttcaggcagaagtcaggagactctctttaggagagctgagaaataacttgagggggaggggccacatctgggggaggattttataatttttaaatctcttaaactatacagctttgagatggaatgattaagctgagcaggcatttgttaacatcctgaaatacgatttccatcctgtccctagagcctgccctcggggtccactgtagactggccttctagaagaaaccgccttataaggctctcttggatagttcagtgacagaacacccttggatggagtccaaggccagctagccttcactgattcaaaattcctccctacagtggatgagattatgatgcttcctttacctcaagccacccctaccccacaaacaatctgacctcatctgtgtttttcattgttagacaaataacatcttgtttttagcagctggggaaccctgaattatcgtcaaaagaatttttaagccagggaatatgagtgtaacctttatttgaaatttaggagtggcacaattagaaagctttgaaatggaaggagacttaggtatatgtgaattaataagcccacttatttaaggtaatttcaaagatttcccagtgagtcttttactcttatgtggggatagcagtggaggactagaaatgttcaagggaagcttcccccagcctgtcatatatggcttttccaggtcaatcaagaccgtctcctccaccaggcctctgagagaaaatgagatcagaagaaaaaagccaggatgataatggggggagggggggaaacgtttacttatttattttttttacttaaaattgattgtgttaaatagttgacctctgttttatcccaagttggattaatggcaaaatgatatggcccttttgaaaaagctaatgtgttgaattgcctttactgttttacagaggagagcagtcaaagttaattagaaacagctggagctaacagtaagcctcacccccatcaatgtccctaccaggagagggttaccagggagaggagcagtcccgggaatccagggaggggcctctggtcccaaaagcaggccagagttgcagagaagttttgtgtctgaaaaataagaaaggttcatttcaggtgaaacagacctaggaaccctgtgttgacaaagccccattcatatggtatgaagttcccacagtaaagagcactgacaaggccaaggccaacccgacaggttcaaagcaggcttggccactgtgaaaaaacaaccccctcaaaacttcaggagaatgtatataataaatgaaggtacaatttcataccttcacaggattattgagaaggtcaaattacataacagatatgaaagcactgtgtaaactatgcggactatgctgcaccaaataactgtaaagaattattaactagactgtaaatgccttgagggcaaggaatgcatctgcaacgggtatttgtgaagtacttgacagtttgctaaggacttctgtggattttcctcatatgctactcataacaaccctggaaggtaaggggaattgttatcccaaattccaaataaagacactgcaggtcagacatcacacaggtggtaaatagcaattctggtacttactttagatattctgctacaggcttgctattcaaagtgtggtatgtagaccagcaacattgactctctgtgctatctttcttttttataaactcggaattatttcaaaataagaagtttctaacaaaagagattcagaagagtcaaacccttgggtgtgaaaaagttttaggaagactttcctgaatttattttgcctatattttgtttctgatgaatgagcaagggggttatatgatatatttgtgtctaaatacatctaaaagagctctttcattcgcataaaataaacatgctgtatgataacaaagtttatgtcagagttgagatggctctttatggtacatatatgctgtgccttctaaaaaatgtcatattatattcagtgaaagatgatgtttcttaaaatgaatgaatgtctctgaggtggctaacattagtccttctatagccagattagcaatcttagagcctggtcaggcacagtggctcttgtttgtaatcccagtactttgggaggccaaggtgggaggatctcttgagctcaggagttcaggaccagcctgggcaacatagtgagatctcatctctactaaaaataaaaatgaaattgttaattggccaggcacagtgggaagcacctgtagtcccagctactcaggaggctaaagtgagagggtggctctagcacagtcatcaaggctgcaggaggctatgatggagccactgcactccagcctagatgacaaggtgagacgctgtctcaaaaaaaaaaaaaaaaaaagaaagaaaagaaaaagaaataagaaacgtagagcctggcagggcacagtggctcatgcctataatctcagtgctttgggaggctgatgcagaggatcccttgagaccgggagttcaagaccaaccctggcaacatagtgtgagaccctatctctaccaaaaaaagaattacaaaattagcttggcttggttgtgtgcctgtagtcctagctacttgggaggctgaggtgtgaggatcactttcagcccaggaggtcaaggctgcagtcagctatgattgtgccactgcactccagcctggatgacagaaggagaccctgtctcaaaaaatagaaaaaccttagagcccaacctttcagttgcaatccagaggttcttgaaggatcagcgagtgtgctagggctgctggcatgaatattagtccaagaaagacctcttggagcataatgtttgcgtgtgctgtttgatcattttccaggtctttctagtaactctgagtaggctagaggaaaagaatcactaaggtaactgtcaacatgctcaagtatttgctttcacctgaggtttaaccctgaatgttgaccttaacccctgactccagcactgtcccatcatcaattttcccagtttgagtaataatatttagtccatatctaagctatggtctaaggaatttgcatttttttaaattgaagcatgtttttgtcagctaggtgacaacttgcagaaggaaaattcatgcaggggtttgagaactcaattaagcataatccatttagacttttgagggagaagaaaaaagagggctttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggcaggaaggttttgtgggaggcttctcctcccatttctctgcacagccttcccaccagctacagagcatcccacgtggcccttacttcacatggagccaccctcaaaggcactgtcctgtccacaccctccccacaaccacgcctgtcatctctctcccagtttccacttggcaagtaggctctgtccctggctctgtggagtgcacccatcttttagctcaggacacaaggttacttggatcctcactatcactgaaagtggaaaattataataattccatcactcacatccagtgcctgctttttgtaaatgatgtgctgggtgccagatggaaatttgccccaggagaaagactgcccctgctctaaggagcttagaaacctgcagtccatcctggtggaagaaaagaagagggagttagactcaatataagagagtccctgtgtaagccaagccaataaaatgcacaggaacaaagaatgcacacacacacccctcaacccttcatttttaattattggaagcatattttctgggcaatttctactggaaggggaaaaaatgaacaaaggtacatttacatctgtggcctgtgaatacattataatttgcagactctatgagcttatacataatgtaactatggctagaggtgtggtagtacataaatgaattagttattactttgcccaaagtgacattccagagtgcagatgagtgaatcttatgtttgcttagacttgagctaaggagagaatattgatccaaaagaatcttaaagattgtatttaaataccttagtaaatgctaaggaaaaaatatgcagtaaattcacttcactctacctagctccctggcaaatgtgtaaaaaaaaaatttaataggtgcaatgacctattgatgagaatactgtttggcagttagtctctaacaattgtcagaagtttcactttttggacaaaccacagtggattttaaattctttttttttttttttgagacagagtcttgctctgttgcccaggctggagtgcagaggtgtgatctccgctcactgcaacctctacctcccaggttcaagcgattctcccgcctcagcctcctgagtaactgggactacaggtgcctaccaccacacccagctaattttgtatttttactagagatagggtttcaccatgttggccaggctgatttcaaactcctgacctcaagtgatccgcccgcctcggtctcccaaagtgctgggattataggcgtgagccactgcgcccagcctggattttaaattctaaacttacatatccttgttaattaaactttagctgctgtgcagcttcagtgtgtcctgggaatgtaagctaatttcattttattttcactaaagatcttttttgttattaaacactaacagtggaaatttgtagaattcattgaaatcaaagacagtcattgttaatattttgtattccattctagtttttttctaggctcatatgacattattttgatcatactaaccatatgtatttatatcttgtttttcatttagcaagtaggtgaatttgcaaatgtggagtccatatatttgcaaattttaaatttataactaatattttccatgtacttaaatattttataaattttatttataaatctatatttgtaataatttgaatgaaccataatttactcgtttttctgtcataaataaccttttaattcacatctttagacacaaagatctttcttctgagttatttctttataatagatcccaaattggaattaccaataaaatgatatgaagatttatatatatatatataaatttttatgtattgacattagtgattccagcttaacagcctcttctaaacaattcagacacattatctcctaaaaacaaaagcccaaaagcaaaacatttcaataatacaatagaaattacttgttaattatcattagatttgtattgtgactgctcatcttcaatggcatagagaccattgagagttgtacctgcatcctagtttctatttataaaatttgcagttactagccataaaaccagggaccctgcctgttacctagtttgcatctaatattaccaggaatcatggtttctatctcagatcatgaagagttattccagcaagaacagaaaggatatgtgtactataatagttttctttttttaagttcaatttgatcaatcaaatatttcaaaataacagggagaaggaaagaatattcctttgtacataattgaattgaggttcataaaaagcatccgcattcttactagagcagcttgaaaatgtttgttgtaagggcagccacccatctgagatgtaaacgggaaaaactttgtgaaatttggaggttttgtctttaagattttttttcacagaagaaaagaaaaggtctctactattctatttgactacagtcaatggcatacctccaggttgaatctcagcagctctttaaatgcaacttccctgcataatactgagaccatgatttgaccgcttgtttcacttcagtttctgatatgtgctgttattctcctcctgtgagggacagcctgtttcctgctccacttattaaaactagaaaagaatttacttacaacatttttaccacacgtgcccttggagctctccttgggtccttaagagggctggcaaagccttgtttctctttttctcaagccctttaatctccagcacattcagcaacaattgtcctttgtaaggcaggtattcctgttaatacagtaaacagtgctgagaatacatgtataaaatggaaaagctgcatgtgattttcaggcagaattattcccgtattcgactgggagataggaacagtaacagcacagtgcattttctaagaattttcacatatgttcatatgcatatcaccttttttaatcctcacaataaccctgtggtaaagtattatcctcacattgtattaataaattaggcaaccaagattcagtgtgtttgagtgtccaagcagagccactgctaatgggaattgaatgaagctggaatgaggaatccaggtgagttggtgtgtacacggacacacacacatgtacccacatttcaatccaaaggaagctaaaattgagtgtcagaagcagttaaacataaatatgcttcactcactcattcattcattcatggttcttccattcctaatcttgtatctcctacattaaattccctgcatagttaatactctgcatttccacagtctccagttactctggtcattaccagtatgtggaagtgcatatgcttttgcctgttttgttcaactgtgtgtgtgtttttgaagaaacacatccagagactctaaggctttgttttggtaaattaaagcaacttaaattccaggtgttggcagtggcagttgtctaacatagcatgataaaattatcccccaggttcctatatgcgtggttaattacaggtgatccaactcccaaagaatacacatggcctggatctctgagctctgctgaataaaataaccaatgtataatttcattttctgtgaaaaatgttaactaaactagaaaaggtgatcaaataaactgttgctctcacatgttttgttttgtttttttgagatggagtcttgctgtgtcacctaggctggagtgtgcaatggtgcaatctcagctcactgccaacctctgcctcccgggttcaagcaattgtcccacctcagcctcccaagtagctaggattacaggcgtgcaccaccacacctggctatttttgtgtgtgtatgggtatttttagtagagacggggtttcaccacataggccaggctggtactctaacttcctgacttcaagtgatctgcccgcctcagcctcccaaagtgctaggattacaagtgtgagccaccatgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgttcagtcagtttgaataaaattgagtgctctggggagactttattgttgtttgtgtgtgtgtttcaacactacagaataagatgtgactgtgacccactaagtccttaaaaacaatagggtatatcataagaactagaaagcctaacttcagacactgacaagaaagcaggaaatactacgtttctcatggtagcaagactcaggaaattcttacgcaaacaaagagtgaaggaacagttgacggcagttttctgaatcaatccctcaacatataaggagatggtgggatttggggaagaggaagagaagaatgatgaccaagaaggacaatagctggtctattggtaaagaatgtgttcagctgcaagtaatagaaaacttggctctagtggcttggccaaaatggggtttatttgcttgtagaacagggagtttaggtgtagatggtttctggtgtggctttaaccactcagcagtgctgtcaaggaccagggtcctttcactctttctgctctatcatcctttgcatgttggcttttgtatacatgcttaataattgcaagaaggcttctgcacctcagatcatcgtcatcattaaagacatttagaaggaatagagaaaaggacaatgccagccacatgtcccattatatcaggtgagcaaatgtttcccagaagcccatactcagcaaatttctgcctaatctcattggccagaaatgatcactgggacaccctattgtcaaaagagacagagaagggggtggtggacactggggctgagtcagccggctacattgtctgccatagctgggcagcagttctttttagcttttcatttcagacacagttgctgaaggtgaattcaaagggtgactagaagcttagtgttttagagaccacagaccccatcagacttcactgaagtgtgaaatcagatgataaaataggtcatagctggggggaaaaatggaaagctttgtagcaaatatgtctttcccaaagttcagtggaaagaagtcctatctgaaagatgtcaaaccacatagagtccattttgaaatgacatttcactctttccttcacagaaataatggctaccagaattgagggttcctgcctgatttaatttaatatgtggaaagggataattttaaaatgaactcaaaaacagaaaaagttataattgtatatggatagatgcagtaaaactgctttaaaaaagtctactttcatttttataaattgtataaacttcaattcatcctcagatctaagtaaggtgaatttctaattattgtagtgtttttaagcttatttaagtcatacatgttatggagattaatgttttggagagggtggggttcaaatccccactcccccacttactaaatgtgtgattattaaatgacaagttgcctctctttttttttttttttatttttttgagacagagtctcactctgttgctcaggctggaatgcagtggtgtgatctccactcgctgccacctctgcctcccaggtttgagcgattctcctgcttcagcctcccaagtagctaggattacaggtgcccaacaccacacccagctaatttttgtatttttttggtagagatggggtttcagcacgttggccaggctggtctcgaactcctgacctccagatgatccgcctgccttgacctcccaaaatgctgggattacagacgtgagccaccgtgcccagccagcaagttgctcctcttaacctcagttttgtcatctttaaagtggggacaatattgcttacccaaagggttggtgagagtattaacttcatatgaggttctaagcatagtgcttgccacacaatagggtctcaatctggccgttgcttttatcattagtagtagtggctaatgcttcagaaacagccctcaaatgtcatactatggtacttttaccttcattcttccctctttttctggagggatatctagagatgggatgaagggtagaagcagaaactgagagtggtaggaatgattggatggtattatatggagaaaatgagggctgttcttgcccaaactggtcggaacctcaatatttttatatacttacaatttatagcctaccttattttaacattatatttgtggcagtttacatcaccatgcttttcagatacagcaatagtgctgcaaaaagcactaaactgcctgggcatggtggctcacacctctaatcccaatactttgggaggctgaggcaggaagatcacttgagactaggagttcaagaccagtctgggcaacatagtgagaccctgtctccacaaaacaaaacaaaaaaaaaattagccaggtgtggtagtgcatatctgtagtcccagctactcaggaggctgaggtaggaggatcacttgaacctaggaatttgaggctgcagtgagccgtgattgtgccactgcactccagcctgggtgacaaagcaaagccctgtatcaaaataaacataaagtactaaacttagaagaaaagagtctgaatcctcctgcctcagcctggcataagccaccacagctggccaagcatctgaatcctgactatacattgactaacagtgatcattggcacattgcttaatctctttgtccctctgttgtctcacctgtgaaatggagcaagcaggacctgtattaaaggattagggttagggttatggaaataaacgaagtcacagatttgaaagcctttgtaactgttaggcctttatgaatccaagattgtattccctctgactttaccaactattgtagtaacaactctcaaatatgcccagtcagttaactgatataaccttgtgtatagctgtgtcagttatttacttttttcctatatacctctggtccactcctccccttcaaatcactatcagcaagtagtgcccacggactcctgtgttataacattagccagaaccaaacagttagtaaggaatctgctacaacaaatttatacagagcaaaatataaagtattttaaaattggcatccttttgagatagtctgttcctctcctgcccttcgttagttgggtactcaagagttggcagtgttttcccatctagaagctcatgctgcatattgacctgcaaaggtattagtccaggtaccaatggcaacttttatgttatccatcaatcactttaatgagtacaagaaagcatcctatcaccctgccaaaagacagaggaattaagaatgactcatttatcacttaaatgtgtgagtgttttctatgtgtcaggtgccatcctggtgctgtggggcacagaacacagactccagtttccaggggtttaccgttaaatggggctgaagcagcaacagtgtgtccgtctcctgtattcaatctcctcataatagctgagccactagatcaggagcagtggctcacgcctgtggtcccagcactttgggaggccgagacaggtggatcacctgaggtcaggagttcgagaccagcttggccaacatggtgaaacccagtctctcctaaaaatacaaaaattagctgagcgtggtggtatgtgcctgtaatcccagctgctcagaaggctgaggcaggagaatcgcttgaacttgggaggcggaggttgcagtgagctgagatcacgccactacactccagcctgggcaacaagagcgaaactcggaatcaaaaataaaaataaaaaataagatggtaaaatttgtatgtgtattttactacaattttttaaaattagaaaacaaaaacgtaaatcctctagataccaaaacccaagccccatggaaaacatttaccacaaaaaggtgacaagctatccccacaaatgccaaaatataagtgggttggaacaagccacctatgccaccaagcctgcaggctgtcagcagctaggtggaaagacacagagggcagtaatgaggtgatgacagatccaataataggtaaatctcaacatagccaacaggttttcactggaaagtccattagtgggtgagtgcaagggacccaaagggtggaaggggcttgagtagcctgggtcccgtgaactctcaaaacccccagccggggctcctgatatggtttggctgtgttcccacccaaatctcacattgaattgtaactccataatctccaagtgtcatgggagagacctggtggaaggtcattgaatcatggaggcaggtttttcccatgctgttctcatgacagtgagtaagtctcacgagatctgatggttttataaagggcagttcccctctgcatgctctcttgcctgacaccatgtaagatgtacctttgctcctcctttgccttccaccatgattgtgaggcctcccaagccatgtgaaactgtgagtccattaaacctctttactttataaattacccagtctcaggtatgtcttcacagcagtgtgaaaatggactaatacagctcccttccaggacagggcccttcaccaaagaaaaactactaggaatagaatcaaaattgagcaggacagaaacaatagagatgaatgaaacaaaagaccaaataaaagtgaaggagggaaacaaacccagaaaatcacagaaagcatgttactgtttttaacactaaatgaaaacaacacaaaatggagttctgaggagttgcaaaaaggtattttggacaatgtctccttgtaaggctgtggaaaaccaattttacattttaaaaaagcacagagaaagattaaggccaaaccccatactagaaagaaattttatataagagaagagtgagagagagaaagggaataacatccctacctgcaatgaaagcacgtctgcaaacaggtgaaaactacaactgactatctgaataacatgagctaaaagacattttttaaataatacaaataaagagtaacaagccaaaattagaataactcgaaaatgtggtgaagatctcagttgttatttcagaaatgaaaccaaaagaaacacaatagcgaataagaacaatagagaatcccttaaaagactaggaggttaaaaggaggaaaattattaaattaaaaagaaaggaggaatgatcaaaagcagcaaccactgaagatatgcagagcagatctagcatacggataacaggagtcactgaagaaggaaaccaaagcaagaaagcaagccaacactaaaaattataactccaaaaaacttcactgaaatacaagaaaaatgtagaactacattttggaagaccagacagtatacctgagaatatggatctagaatgacaaatacctattgatattctagtgaaaacaatactgcactttaaagaaaaagaaaaaaggatctagcccaggtgcagtggctcacatctgtaatcccagcactttgggaatccaaggtgggtggatcgcttgatcccaggagttcgagaccagcccaggcaacatagtgagaccctgtatccatttttaaaaaaaattatccaggcatgatgtcacacacctgtagttccagctacttgggaggctgaggtggtaggacaaactgagcccaggagtctgaggttgcagtgagctgtgatcacatgactataatccagcctgggcaacacagtgagaccttgtcccaaaaaaaaaaaaaaaaaaaaccttttttaaacatctgagtaaaaagattaaatgacttataagggaaaagattacattatcatcagatcatttgacagcccctgattttaccacagaaactagaagccattgaataatagaggcaattcaggtttccttgcaagccatttttgggcagtgccttataagtggtggaagcaagaattgctgcacgtgttcagaggaagtagccatgacttccacctaggagggcttcatggaggaggtggaatgattgcatcttaaagaaatcttggaaaatgtttaaactgccgacatcagaatagtataatgcataaacatgtgacttaccctcaaaatgttcaagtctgtataatgttgaattcattgcacaccatttcatgtccatgttttttcttcatgatttttagaaaaggcacttcatttttggctaaaggaattttttttaatactgaaatttgagtaattgattctgttaatccagcatatgctcctattaaataaattgtatacaattcagtgacttcattagagatgataagccacatacttaaattttgtgatactccctgataatctgcattcattgataattgagacaaaattaatcatatataatcaagcaaaaatgcgaacaaaattagctgtcagaaaagcattatccagtctttattttttagttaactttagatattttaacaacacataaaatgagtggtagggtatatttgtattttactgtataggacaccttcagataaattctaaaaataatttgcatttcatgtaatgcttttcacacaaagtaatggccaaactttagggtcagtttgccctgcttcataccacatgcagaacaaatttaagatggattaggactccaaatagaaaagaaaaattcttaataaaaaactattcaagatggataaaaggattaatttcaagaaaaataaaactaataaaatagaactattctggtaacccagaaaccataagagaaaggattaacagattagctgcattaaaatttcaaatttattacttattcattcacccattcatgagataattgtttttattgagaacatactatgtgccacgcaccattcctgctgctgagggcacagcaatgtactaaacagccagcatcactgcccttgtggcatgctgtatggcaaccaaaaccataaacaaaacaggaagacagtaatagcctggagaagttatttgcaaaatatttgataagcaaactaaatatctgtagtaaacaagagctcatgtaagttgatcgataaagcaacaggaaaaagagaaaagtaataaatagtgaattaaaaggaacaactgcaagtggccattaaacatgtgaagagttgctcaacttcacaacaagtcctgaaatgcaattagaacaacaataacctacaatgtttccccgttcagcttagccaaattttttgaaaatttctcactcccactgctgggaaatgtgcagggaaatggggaccttcctgcactattgccaagaccagaattcctaacaagcttttcaaaagtaatctaggagtatttattaaaattaaacattctcataccctttgacccagcaatcttatttctggaaacctctcctacagaaacaaaagtgctaacgcatagggacataagtattaagaatatttattgtatcatagtttgtatatagaagaatttggaacatctggaatattcttaaagaattatgcccatgtttggggacattttgcagctattggaaagaatgaatttgatttatgtgtattgaactaataaagctaatacataatacatggattgttcactgaaaaaaaggcagtttaagccaggtgtggtggtgtacacctgtagacccagctactcaggaagcttgaggccaggagttcaagataagcctaggcaacatagacaaaccctgtgtcttaaaataaaactttaaaaaaaatttaaagcagcttgcatgttaataggtatgaaattttcattaaaaaaataaaaactatatgtataaacagtttatataagttgttggggggttaggattatcaggaggtaaaagtagacaacttgctgcttctttatatatttgtatatctgaattgttacagtgagcatgcacttttgcattttttaaatagcaacaaaatattttaaaagaatactgaaccactacatcattgatattcctcataactaaatttcgaaggttcttttctttccttcttctaattaccaaaaacttgattcaaatttaaaactatacactcatagatctagaatgattctggggtgatatttcagttcatcattaacctttccctaaccacttccctgtatcatcttagtctaagagatttcaaacatggcaactccaaagacgcaggtcccagaagagctctctgagaccgcgatttgggacccacactggtcaaaagaggaaaatcacagagcatcctttgtaaactcagccttctctcaggaaagtctttcttattataactgatattccttgggctgaaactcacacctgttcctccacttctgatgtagagacaaagaggattcttgaccccaaaggacctcctagatcattgcttcaacctttccattttacagatgaaaaaactgaggactaagtaaaatgtggggagaaatggtaccaaaacccacttcccctacttgctaatcagtgcgttttctgttgctctagtagtacctttctttctcacataccagcatccccgagtcggttctacaacagggcctttcacccggtaagccaaagtctgttggatgcaaactgcttacacagaatcccaagtagaagctaagttatcaacgtcaaaggaccaggaaggcagggtgattcaattgcaaacccaaagcagcagcactttggagccagaatagaactctgaatagtcctttattttgtgctgaggacctagaacttccacttttctttctctggagccagacttcatgctggggctttgttttaaaatcaaggccccagcggactcagaactaaggaatttttttcacacatattcaaaacggaagccctgccaccatggggaagctcaaggtccttgctcagcttctgcttgtgtttgggctacatgaaaatctctgggtggtggttgatgtttcccgcaccaaatgatttctgcacaaggcccgacattccccctgccctgatagaagggtcacaccacacaccaagaaggatgtgactaataaagagtgtgacttcagagaatttacaagtccagacaacttctgataaacatttaaacagaggtcaggaatgttttcctttctgaggggaaaatatgtggtctatggtgtgagtgggaggggctggtggggggtaaatctaagcattagcttcctcccttcataattcttaagcattttaacagcagtcatttttaatgccctaacaggctttcagacttagaacccatagctgagtatgggccagaaagctctgtgaaaaaaaaatgggcaattccaaagtgattaccaagcaagtttaaaactaacattaggatcattagaggcactttccctgggccctgccctgaagctaagaatgttccagaaagtatcactcaaggcccattttaagtacccaggttgggatcttcacttcccctgctgacaaaagggggaagctccatagaggaaatgggtgttgacttccaggaaaggaaaggtgagaaggaccagatggcatctgtcagcatcctcagcccaccggagacattctgagaacattggccagggccaaggaggagagattgatgagcggaagccaacagagatatccccttggcagtggaaaggaaagctgcaggtcgtttttgtgacccaacacactttcattggtggtgctgatccagctaatgtcttttagcattttccttttcattggctgtttggtttgtctcctgacatttcctggatcggtgtgcacggtaggcatagggtgagtgagtaagactagtattctctctggtcagttctaaataaaaagtaagaaaagaaaatgtcagccaggtgtggtggtgcacatctgtagtcccagccacttaggaggctggagtgggaggatcacttgagcctatgagttagaggctgcagtgagccatgatcatgctactgcactccaccctgggtgaaaagtgagatcctgtctcaaaaaataaaataaatttcactcaaaatcttcctctaaatgggaagatggggactcagtattggaagaaaggttctgataccaactttaggaaaacccttcgtgtgtctgcaatcaatattcttttgaatatatcagcttccgttgtttcagctataacccctgtaggctggagcactcgggcaatgtgagtagaatgcagcagtgtcaatttccctcctttgaatcttagacaggtagagaaattatctcattttaaagtcctaagtattcccatactcagttttagacatttcttgcttttcttactgagataaagtatgtttttttgaaaatccagtcttcagaaatctcattcactttgtcattggttcattcattcttgtagtcattcattcattcaggtacccaccaagccctgtgggagaccctgtgttgggctaaagggccatgtcaataggccatcactcagaaaaccgtgggaatcgtggtcaggatggaagttctagagtcaaacctaccctgaatcctggctctgcttcccatgtgctctgtgattctgggcaagttatttaacctctcaaagcctccaattcctcatctctacaatggggtaataagcatagccacttaactagatttctgtgaggattacctgagataatatatggatgagcctgcactgtgcctggcatacagtaaactcagtaaatgataatagaggcaatggtaaggacagtagtaacttttattattaacaattattaatgagacaaatagcatgagagtgataggaaaagcgctgttagatgttggacagaagataactgggaagatttcatatagaatttgacttactagatttttttcacttgaggtttaaaaaaaatcttagtggagaaattgggaaattccctttcctttgcatttcattttctattactttcctgaagactgaaacttcagtgtagaatttagctgaaggctacatcccagcatttgcattggccttggagtgccagggtaattattctgtcaattatttgactttttaaagtctgtctaccttgaagaacctctgcaaaggaggactgtgttaatgtgtaacacagagataagcaaggctctgctcttttttttttcccatggctgttcaactggaaaactgaaatggttctatttgcgtctcagccagcagtgttgaaaggtgggggataaatggcttttactaatgaagtacagtgggatgtgaattttagcaatgcaaaatgccacgtatcacctgcaatttgtttttttaaaacacacacacacacaccaaaaaagggaaatcacaagacaatataaacctcgcttgaagaaacgatcgtgtttaacaagacagcaaagagaaatactctgagttgagccaagtagatgtgtgctgcttttgtagatggaataaatgatcctcacttgcatagacagcaaggtcatttttctcaccctaaatggaaggcattaatcatcagctctgaagaacaacattcaggacaagaagaaacaagccaccgcagcaggaggtattgaattgagccagagaactgggggccctgtggacgggagccagctcagcccaggtagcagctcccagatcagcaggggtgggtggtggagctggtcctcttgagccctaacagctttgttgggaactttctttgttcaagaaatctcctagttaccatccaagtgcatttctgaaatgcctgactgtgctccgggctctgtaggctctggattagctggttctctgtggaccccgtctgcataaaaagcaaagatcaaaggaacatggtagagctctttaaaaaaaaaaaaatcctaaactcacaagtgaatgggaaatgcatatttatatcactggcccatcaagggtaagggtgttctgtgagaggggaggaagagaaatcattaagcaggagcgaagctcttcagattaagagctggaagaactgcattgaagactaagaggagactgaaggcaaacagtggatcttttaccatttttcttttttttttttagacaagtttgaaatcgagttttaccgctttcccatcagctacaccaagtagtttacttgtgcagtggctaattaatttgttgaggcagaattttaggttacctatgaggtaatatggaatagtggttaggaggtgtctagctttttgatcccagctctatcatttatgagccttgtagcactgggcaagttactcgacctttctgtgtctcagtttcgtcctctgtaaaataggagacagtacgaacctcacagggctgtcgtgagggttaaattatttacacatatgaatgcccatagtgagcagtcagtgaacaggtattgctgttgattttgttaccgtggccacagttgggtggggtgggtggtgcgtggcaggaatgagttgaggggggaaaagagtaacatgaaacaggataatagaatgtggttgttgacaggaaccatgaaagtcatccggtccagctcccccttaaccaaggaaacaaatcctattgcattttaaaataattgttttgaaattgtaagtaatagtgccgatttattgattgagtgctctgtgtgccagacagcatgggaagccctgcgcctgcatcacaacactccacgaggcctgagtgctgttattaccccattctgtagatgagaaaactgaggctcaaaccgttaagtcatttagccagcatcacctggatcggaatgcagacctgtgtgaatgcagagattctgtgagtgacgcggcagttctgttccctttgcatttcatttcctgttacattcctgaagactgatgatgcttcagtacaagattcaactgaaggctgcattccagcatttgcattggccttggagtgccagagtaatatgttctgtcaattatttgaccttttaaaatatgcctgcttttggtcagctgtggtggctcacgactgtaaccctagcactttgggatgctgaggcatgcagatcacttgaagtcaggagtttgagaccagcctggccaacatggtcaaaccccgtttctactaaaaatacaaaaattagccaggtatggtggcatgtgcttgtaatctcagctactcaggaggctgaggcaggagaatcgcttgaacctgggagatggaggttgcagtgagccgagatcacatcactacatcccagcctgggcgacagacagagtgagactctgtctcaataaataaataaatatgcctttcttgaagaactgctataaaaggaggactgtttggatgcgttctgtggtctcacagaagtgaatgtataacatccatgaatgcatgccttattctgctttgtctctttcatataaacccagagcaccatattttgtttttttgtttttctgtttccacactatactgacatacagagtacatattttgaaaaatactttaatactattaattttgagtaaatcatgtttcagtactagtgaggttagcgtttaaaataaataatatttattcataaaaaatttccctttggaatcaagccatcatttgattggatatgattgaaattatgagtaagatgaaggatacatccctgacaactttcaactattgctcagatacacatgactgcgttttcaggaagtctctttattgttggatatcctttactgctgacagaccttcgttaccttgaccttaaataggtaatgattctttgatcttagtgcttccctctgaagtaactaaaatcaagactgctcattctctgacatggcttcccttcaaatgtagaggatatttcacaggtgtgtccccaccccaggcttctcttccttaagctaaacacccacatcaccttctaagctggttttcagaccccacaagatcctttaatctgtcggttctactcttcacctcttggaagggagccagtgctgcaagactgtcggatctgtacagagcaggctggagccatatgcttacacgaaggtgaccaaaatggctggcttcttagctttctggcttcattgatgtcagggaggttgcgtggttaaataatgaaggaggagtgacaagcaagagccaagagagggacgtccaaggactgtttccaagtgatccatggtagaggcttcatggcattcctgttgtttgtgctttgagcaagaattccttggtacgttggttctagtaaagagatcagctatggtctgaatattggtgtcccccagaaaatttctctgtggaagctttaacccccagtgtgatggtattcacaggtgaggccttcgagaggtgaatgggattagtgtgctataagaagaggcaaagaaagatgatctctctttccaccgtgtgaggctacagcaagaaggcagccatctacaagccaagaagtgggcctccccagaaccctaccatgctcgcaccctgatcttggacttcccattcaatacacttcagatgcttaagccaccaggtccatggtatttgttatagcagcccaggctgactgagacaagagccttggtattcgagatttttatatcgtattcctgaattctcgaaagttctgaaaataaagagatgttcatagggcccatatatagttatatataacagatccatgttccaagtggacaaggatgagtggaaaggcaggtacttcagtcatacacagatattcaggtagctccttgatgacctgtctacccaccacattcctctgccttgtgtctaccttttttttcaaatgcgaaaattatctggactttatttttctacttgtcaaattctctttagctttttttagctgttgtgttgacctcttctatctctaaaaggcatttggttattttttttaatgtttttgcttcactgaagcttagtgtgctttttatggttttatggttaccttgcagaaatctcattagaaaagcactttaatatattacttggcaatgagacatctgacaatgttctagttcattagttaggaaacctccccaagcttggaggaatagacattcctctgtgaatggtagagctttgatcactcctgcaggggccaggatttattttaatgcattttaggggaggagaagatatcctaagcctggcaaaataaaaataacacagattaaggaaacaatgaaacattattttaaaagaaatgcacttcagttaatattattctatgggatctcctgagtcctttgaaggcagagcttatcttagaaaatatgtctcctttagtgggcaggaggttagttaagcaacctcacaccagatcacagattatactgaaatgatcctaataaggaaagactttccaaagctatactcattttagcatgaataaatggattcaagtcttatttgtgggattttaatttccaactttgaatttgcaaactatcaaattccttcaaagacacggtgtgcagagaaggctctgagtaataggattgcttatttttaaaggaagatgccctttagcaaagcacgaggctttgacatgtgatcagtcaagggtccaatcagcacggatttccccacatggcactgtttcttgttgagttccaaccagatttaataactcatacaaaatgcaactccaccctgagggtgcctagtgcattcaaagcagataatgctatattgttttaacacagattatgccaaatgaagtacaatttaaattcctgaagcatgacagtccttgggtgcttgtggctgtgttttagttgggtgctgtatcttttctttctttcttttaattgaaagacttaaaagaagcaagctgtctgaaaaagtgtttaaaagagcttggttttcaaatggtataaataggacagaggcagaggatgctatggaaaaagggccttcctccaactttaagaggtagaggaaagaaatgggagagtctgggcaaaagtgacgtaagcccctgaagtcaggctggagactcttttgtgtctcatgtgaggagagaaatgggtgaagcctatagtactttcacactcccctgaatgggaagtagaggccagatgccagttgcagcttctttttaactttttaacaccttcagaggcaggagaaaatggtgggtggggggaatgtttttatttgggattagaggtaaattttcaggccggacgaggtggctcacgcctgtaatcccagcactttgggaggcagaggcaagcagatcacttgaggccaggagttcaagacaagactggccaacatggcaagaccccgtctccactaaaaataccaaaattagccaggcgtggtggcacgcacctgtaatcccagctactcgggaggctgagacaggagaatcgcttgaacttgggaggtggaggttgtagtgagctgggattgctccactgcactccagcctgggtgacacagcgagactgtgtctcaaaagaaaaaaaaagagagagagagagagagatgcattttccaaagaggaaagtacgatgggcagagtttggaagctcgcttgctggtgccaggacagtggctgggtgagctgctgcccttgggaaagtcgctaggtcctcccatctttcctcttccgtttttcctcacctttgtgcgatagagattatgatcactcccgatcaactccacaggactgtcctgaggatcagataaagagaacacgctttagaaggctcaccacaaatgggctgtggccatggaggtggtggtggtgacagtggaattggcatctgggttggcttgtagcctggcctgtaactgtagttgtggaagcttagagggctgtttgaagaggcccctcctagtctgacctcatgagccagagacactagtaatcttgggcagttctggggcattttgttgttatttatttatttatttaatttttttttttgagtcagggtcactctgtcacccatgctggagtgcactggcaggaatctcagcttatttcaacctcaacttctctggcttgagcaatcctcccacctcagtcccccgagtagctggaactacaggcacacaccaccatgcccagctaatttttacattttttatggagacagggttttgctgtgttgtccgggctggtcttgaactcctgaactcaagcaatcctcccctctcagcctcccaaagtgctgggatcacagacctgcaccaccatgcccaacccaaaatgcatttatttaatatacatcacaagcactcaactggaggcttaaaagactaataataataataataccacagctcaagatacagagtgctatacaaaaatcacagaaaggacagaccatctaaggaaaacttaaaaagacgacacaaggacaggctgggcagcctgggtcagggctcctggctggtgacctgctttaagtaggtttcttgcaggtgcttcttaaaagctgtggggggtttccagagcttggcagcatgcctgttcaacgagctatcaatgttgggtttgcctcgaaggctgtggatggagagcaggatggtcctgacatcatacagggcagaccacttgtccttcaggatgtccaggcagatattaccctgggtgtccatgttggggtggtagcagggcgtgaggaacttcaccatgggtacattgtaagggtagcccctggggagctctagggagagcttatacctcaggtcttcatatgctgtgccagctgctcaatggatggtccccacccatttgaaaaggttgcctgattcaggcaaggcagaaatccctgtgtcactaggcattgtgaaggtcaccaactcctgctgtagccttttgcccacaaggtaccgggcagcacccctgctggtggtggctaggcagcagcaacgctggtggtggctgggtcaaggttttgacaggccatctaggtggcactgacagaaagataggaacttaaagaacacaactgcaactgcctatttaatttttttgagacagggtctccctctgtaacccaggctggagtgcagtggcgtgaacacagctcgttgtatcatcaacctcctgggctcaagcaatccttctgccacagcctcctaagtagctgggaccacaggggcaccccacacaaacacactcagctaattttatatatttttgtagagatagggtatctgcagccataaaaaagaatgagatcgtgtcttttgtgggaacatgaatggagctggaggccattatccttagcaaactaacgtagaaacagaaaaccaaataccatgtgttctcacttataagtgggagctaaatgatgagaactcatgaacccaaaaaaggatataacagacactggggtctacctgacagtggagggtgggaggagggagaggagcaggaaaggtaactatcgagtactgagcttaatacctgggtgatgaaacaatctgtacaacagacccccgtgacacaaatttacctatgtaacaaaccttcacatgtacccccaaacctaaaataaaagtttttttttattaaaatttaaatttaaaaaaagagataggggtctcaccatgtttcccaggctggtctcgaacttctggcctcaagcaatctttccatctcagcctcccaatgtgctgggattacaggcatgagccactgcaccaagcctaggacatttttaataatcacctcccttaccccagccaaggttcccaatcctcagagaaaaagctgttcaagacaaaccttcctaagcagacccaaagctttgacagcccatatgaaacctgcctaggagtaccctgctagcctccatgaccaaatacgccacagcaaggctgatgtggctcccttagacctattctgatatcaactgagatcagtcccttattctgggcggagagcctgatggccacatgtgtgctgttagaggacactgcccacacagtgaccacccagggaaaaagaaagagagacccaatttccttgtgtgtgttgcaacatggccagtgttagagatccagggttgcttaatctaaccccaagtgattaagaaccagctatgataccagactgagtgcaaacttagttgtcagcacagataaagaaaggaaatagacacatcagatgtaaaagccccaaataggcctcctactgacagatcctgctctcctaaagcatgcagacctctctgacttgctgagatgtatgtatattcaatgacagcatggaattgaatggttgactagaagtggctttccagaggctgcagcaggaggaacattctttgtaaacaccaagtatttcattcccccccaatatatcaaaaacagtgttttcagtaggatctggagtactgcattgatgggcatcacttttgaccaacatatgctcatgcggtaccttatatagattcacacacttcttctagacaggctttgccaccaccttatgcacatggaccctcgggacttcagtaacttgcagggccaggtgtgttcagagcagaagaaatacgaagtagtgtgcaatgaataggtgcagggagaacccgtcttcaaatgaattggactttttaattagcaattttatgtgaacagattatttaatacattgagatgtgtgtgttacagcattcaacactgatccacaagcttgaacacatttgtgttttagaattaatcgattttaatcaagtagaaaaatgcactgaacatcccttgtatccaatgctcattacccctgcggccagtttgtgagctggcttgtgttgtcttagactttcagaagagaaaacaaaggtcttcttattgaaccttttggttgtacattgcatgtttgatttgagaacagttatgattcaggcctgcagtaagagattgagagccttacatcattataaatgtggcctggggcatccaactcatttaactagaggataatgcagaggagtgatttgcaactgacttcttcctcccacaaactaatatttttaaatggtttgcacttttttctgtccccaaagggatttgttaagtgtgattttcagcaggacatgtactttttttatttgttagccataatggaaatgcatagataaactgaatctgtgttaacataataagacaatcaaattttttgtttagttgtggggaagggacgggatagaggaagtagaaaaagctccctcaaacataagctgaatatttatgtggtttttgtttttatttaaaccaacctctttagaaaattactttcttaataagacattatacaatgaatttttccagtcattttgagggaaaaatatggtactctgggagaacttctagaagaaagaggaaagactcacttaagattcccaggacctacagagggctggtgctgaatagttcccactgaggaccttccatttcggtgttttttgtcttttgtttttttgagacaggatctcactttgccacccaggctggagtgcaatggcacgattccggctcactgcaacctctgcctctggggttcaagcaattctcctgcctcagcctcccgagtagctgggattacaggtgtacaccaccatgcccagctgttttatatttttagtagagacagggttttgtcatgttggccagtctgttctgaaactgctgacctcaagtgattcacctgcctcggcctcccaaagtgctgggattgcaggagggagccaccacacctgaccccattttgttttgttgtgagagaccataaacagcctagaaagatagaaatctcaataatgagaagtttctgtaatgtgtggctcctgcccaccttctctctgcttatttgctgtcttttttgtttgtttgtttttttagagatagggccttctctgtcacccaggctggagtgcagtggtgacatcatggctcactgaagcctcaaactcctggagtcaagcaatgcttctacctccacctcccgagtagctgtgactacaggcaggtgccaccacagaaggacagaccatctaaggaaaacttaaaaagacagcacaaggacaggctggacagccaccagacctggctaattttttattttttgttttattttttgtagagaccagacctcactatgttgcccaggctggtctcgaacatctggccccaacaatcctctcacctcggcctcccaaagcactgggattataggcatgagccatcaccccaggcctatttgctgtcttgattctcttttctgctccctccagccccacagatggcccaagaccccaaatgggcagtcaagcttccccactaagttgagtttctttactgggcaactcaagatgtcttggtgagatcctgtcttgaaacaatgccaggaaagtacatgaggtctccttcctcctaaaaacacccctagaaggaggcctgggaggggcaagcctggcggttcaaactggtgattcaaccacccacataagaccctctaggcctaatggctgggtgaggggctcagagaatttctccaatcttggccagaaaggcttccttaccactttcacatttctctcgtgtccttcagaaggggcctgcatccaaaagtggccatggaaagcttcacagaattagcttttattgtaaaaaaaaaagtagcaaatggaggaatgactgaagagaaagcatgctccagctatcagtcaactttgagggcatgagcccatgttctaaatttaaacacaatctgtccctttctccttgtatatccggtttcctttcacttccctcggtgccttcaactaatcccattcttggtttactgcttggcagtgataattatatacatgcactgtgacagttcaacctttcatgtgccaattcccatcttttgatattttcttttattttttctgtggaaaataatatgacaaaatcctgccatttgtatgttcttcatttttgactccaaccatgcactactgaatagaaagtatctcagcctcctttatttttctctgccgttactgatgtgtttctaggcccatcttatctgtgcattagctcattacttattgtcatcgcttgtcactggctgccatttcccccgcctcccttgggtgttgtgtctacacatctttgctataggggaaattagatagtaaactgatgatgtcagtcctttgactggaggttagcatttcaaatgctcacatattttttgttaaactcactttttttttttttttttgagacagggtctctgtcacccaggctagagtacagtggcacgatcttggctcactgcaacctccacctcccaggctcaagcgattctcccacctcggcctcccaagtatctaggactataagcatgcacatccacacagggctgttgcccaggctggtcttgaactcctggactcaagagatctgcccacctcagcctcccaaagtgctgtgactacggcatgagccaccactcccagcctaaagcccacttcttttgaaacctcaacctatttccagatcagtgattcccaaatttcttgtaaccacaacctcttctccttatgtttggtttagatattttatgatatccacatttttcgctaccctatcaattattctccagggggaagagagcaacattttttgttttttatgaaaaacaagtaaaactttttattttttattttttttagttttgaggaatttttgagaccatacaatactcggtggtctattggagaagtcctgaagtgttgcaaaaaagcaatcactgctttgaatcttggaataaggtcattttaatctcactcactatgttttttcttgatgtgttttgtgatagaaaacacataatatgaaatctgccctcttcacaaagttttaagtgtgcagtacagtgctgttaactataagcacattgctgtacagcaggtctgtagaattttatacccattgaacagcaactcctcatttctcccttaccctagcccccggcacccaccattctgtgtctgcttctataagtttaaatactttagatacctcatacaaatggaatcatgtcatatttgcccttctgggactggcttctttcttttagcataatgtcctacaggtacatctgtgttatggcatatgacaagttaatctcacttattatttcttaaagtgtaaatacaagactaacaaaaaaaaatcccttgtgtcttccatgcactgtttaaggttatagaggctcacagttaaggcttacgttttggggtccctgggaggatataagttccagctctttttcgtataatgatgaaagtaacataaaagattctaggatggcaggtacaaagaacatgttaagaacagcccttgaaaatatatatcatcattgcagacatcttcttggggtcaactcataatgttcccaaataaataactgtccatccatgaggactttgtttgaatatgttattgatactttgttttgtttttggttttttaccctaattcttggagagaggactttatgactaaaaacacaccaaaaaaaaaaaaaccttccaaaaagagattatgattattaattaagaaagaactctagctgatgatggagaaagttcaaagatgttgtattattcagtttttttttcttcttttaaaacaattaaagccaagcatggtggctcatgtctgtaatcccagcactttaggaggccgaggcaggtgaatcacctgaggtcaggagttcgaaaccagccctaccaacatggtgaaaccccatctctactaaaaatacaaaattcactgggcatggtggcgcatacctgtaatctcagctacttgggaggctaaggcaggagaatcacttgaacccaagaggcggaggttgcagtaagccgagatcacaccaatgcactccagcctgggcgacagagcaagactccatctccaaaaaaaaaaacttaaaactaaaggaaaatattatttgtttgctactgcacaataaattagtccaaaacttagcagcctaaaataataataaatatttaccatctcacacagtttctgtggatcaaaaacttgggagtagcttagttttgtggttctggcctggagtgtcccctgaggctgcagtcagtatgtcagcagggactttgttctggctttggattgactcactcacatggccgttgtcaggaggacccagttcctcatcacatggacctctcctttgtgccctttgagcatcctaacagcacagcactggcttctcccagagcaagtgatcccacaaaaagcaagaaagaagctgcaggcatgcactgtccctcccactgtattttattcaagtgcgtcaccagagtaagtcactaagtacagaccacactcaaggggagcagaattagctccacctaaaaagtggggggtggatttgataaagggatggaagacccatgccaccagaagggtggatgggaccttaaccagatactctagtgatactcagggacaaagagtgtatggagtctgagcacaaactcacagctatggtccatgctggggctggagatgggggtagggagcaaaggaacacctggccagacaaccctgagagtcctctgggagtgaggaccgtggagcagagagagataacgggaatggagtaaatgactcaaagatgtgttagagatttcctgaggatgaggccaggaggccaccagagaagtgaatgcaggtaaagacagtggttttgaccaaagagcaagggtggatgccccaggccagcccaggagcttggcgccactggaggaagtgcattataccaatcagagcttcttttgctgctgctgaaatggaacggtgccatcgggccgtcttctccactggagatgctccttcagctcagcaggacgctagctcggaactcagactgcacatttttgcggattgggaggagggccgacgccgtggccggatagtctctggagctgccttttgggggtgtttgcctgttggcattttcagtactccacgcgtcaagagtgagtcactttctcttcttgtcatgaagttaaattcctggtatgtcatcttcattttcttcagagcccctttccaaaactcaacttttgtttgcttcacaaattgccctgctaacctccatagactgagtttatttgtcttgatggatgaatcagagtctcaaactcatctcttttgctccagctctcttggcagagaacacaggaagatgggttttgcttatgtgtgtgtttggggaggactttttttcctttgtttttctgtcttagccatagcttgtgggcgagccggcacctgggaccttgaccgccttctggcgtgggccgaggccacatggggagttctccccagtacgttttgtgatgttccctaattccaggatgggctgcagttttccagatccaaggctcaggggaactgggggaattacttccctggagccagccttatcttatttgtccatgtttcattcatgcaaattggaaatactcccacaactaaactgcctgctgaccatctgcctaggcagtggagctgtggatgcttaatggctttcctcagcaccttcctaatctcttagcttcgcactgtttccatggtagccagccaattgagaacagatcatgtttttgctatgttattaataaagtgcaagaagttgaattcctgtaattctagttccttttctgccgttatctaggaatgagctgaggcaaatatttaacccctggggcctcttatataagagatttggtcaagatggatctcagggcccttctaagtctcaagttcattggctataccatcatttaggaatatgaaaatattagtagggaaggatttatttatcacaagaggagaatctctatactttctcttgtcacccagctcactagaaaggatctgcaccttagcaagagatttccctctgcattgtggaatcggcagtttcttcatgttgggaaatagaatctaaattcatgtttttctcttaaaaccatacaaatgttcttaacatctttgtataactgaggcttatgctttgctggttgtttcttttaaatccattttcccaatataaaaatattgcttgtcaacacagacttgcacttctgcagttttatttgtttgtttgtttttagtcacccaggctggagtgcagtggtgcaatctcagctcactgcaacctcccgaggtgggaagatcactaggctgaagggatccaaccaccttagcctcccaagtagctgggatcacaggcacatgccttcacacccagctaaattttattttttgtgtgttttttggaggggtagagatggggtttcaccgtgttgcccaggctgctgtgaaactcctaggctcaagggatctgcccaccttggcctcccaaagtgctgggattacaggtgatagccatcatgccggcctgcagttttcaatcgttactctaaatgtcactcgggcttctcccactaaaaaatctgaccacttaacctccaatttttaaattttataaattgactaataaaggaatatgttgctacagcgttaatctttatcttttatctcctgggttttatctaagtttttaaatgaaattgctactgttttatagatatttaacttacgatctatgttagtataagggtaaaaattgagaatcagcaactctggtcattttattgctctagttgagtggctgagtcagaaacataaaaagggcatacccaaacattgacctgtttgtacctacaaacagctgaggaccaatttgtaaataggtcacagttaatcaaaatctctgcacttgaatcttttccaaatgctaaaccatgcccttctacaaactgtggaataaaagtagtcatagctagctatgtctagcatagtccagagtcccctgaaaatcttttcaatgatctgcaacaacaaaagccagtttcttggaatggttcctaaactcttgttatttaaaccttcataggaaaatactaaactgtgtattttggtagtgacattggttcactcaactactcagcagtttgctgattacctgctcaacgccaggcgttggaacacaggaaagaactagagagaatcaattgactggtccttagcagcacagagcccacgatctaatggggtatgcagcaatttcaatgcattgtgaaaatgctatgataagggagagtcatgtaagaaccaggcccacattctaagttggaggggttggattcaggagtgaagagaggtgaggaaaggtcaaaggaggtttgtcaaacaaaaaggaaactaatctgagacatacaggatatctaggagttaaccaagcaaagctacggaggggtgggaaatggggggaatattctagaaaaaaatggcatgtgcaaaggctaggggctagggaggacaagacatgcttgaggagccacagcaagttcattatggctggagctcagggttcaggagggatgtggcaagaaatgaggctgggaaaagctacccagagccagatcttatctattctggattttacagtttagtaaatgtattcattcaggaccattatcttctttctggtagttagaaagtttttctcaagaggaagatgtaaatctaaaacatttcaaatcccagagagaaaacattttctctaatagaaggattgctggactctacccaggagtgtttaccaagtgttaacattgacttttaaagttttcctaggattcctgccatacaaggtaattctatgcatatggcatctttttaatgatttgcaagacgaaacacaaagcatattttcaaatactgattttcacattaaacactgattgaaaacattaaaatccaataaaaagggctcgggttcccagatcactttattctaagatatgggtaggacttcagccatttggccacgatggggttatcatccacccagaattcagtaaaaggaggatgattcccacctatttggggttgcaagtctaagctacttatccagaaccactcagataacacctcagaaacatttcagaccgggtgcaaatagtaaagccatgacaccggtttatgattccagcaatatgtgaccttttctccaaaatatattaatgcttttactttcttgtttttctttctatcttggtagcttgtagacataactaatctccttggcttgacattgaaaacctctgtaatctagtttggcctacagttcttaagattctgttttcttctccgcaaacacctcactctccaacaaagcaaaatgagacacaacactccagccatacggattatgtagacaggtatcatggtagcatcggggaggccctgggtttggactcagaaaacctaaattcatgtcctgcccaccccatttccagtctgtgtgacctcgcacaagacacttagtcccactgaacctcaatttctttatctgtaaaatgactggcttctctcacaagattgctaggaaaaacaaaatgaagtaatggctataaaaacttgctgtgaggctaggtgctgtggttcacagctgtaatcccagcactttgggaggccgaggcaggaggatcacttgagcccagaagtttgagaccagcctggcaacgtagcaagaccctatctcattatttttaaaaaagtaaaaataaaaataaaatttatctgggaggtgtaaagcccattattaatgtaaagtataggagtccgccctcatccatggttttgctttccagtttcagttatatgcagtcagttttggtccgaaaatattacatgggaaattccaaaaacaaacactttctggttttacattccacacagtcctgagtagcgtgatgaaatctcaccccatccagctctgtccaggctgggatgtgaattttttcctttgtgtgggtatccacgctgtcaacaccacccactcattagtcagtcagtagctgtctcagctgtcagattgactgtcatggtatcacagtgcttgtgttccaagaaacccttattttacttaataatggccccaaagcgcaagaataataaatttggtttattgttatagttgttctattttactattagttgctgttgttaatctcttaccgtgcctaatttacaaaacagattttatcagaggtatgtatatataggaaaatattggaaaaaacatagtattaatatatactattaatatatactgtataaagttcggtactatccacagtttcaggcatccactgggggttttagaaagtatcccctgaagggataagggtggactattgtatttttatttttcctgcaaacgacacacagttttcccacatcttgaacatactgatccccttgcctgaaagcccatttcctctttcatgaatttagttctgacctactcagtaagaattttttttttttttcagagacgaaatctcgctgttgccccaggctgcaatccagtggctattcacaggcacaatcacaggcactacagcctcaaactcctgggtttaagcaatcctcctgcctcagcctctcgagtagctgggactacaggaaaaaaaacttttttgccccgtcactcaggctggagagcagtggcgcaatcatagctcactgtagccttgacctcccagggtcaagcaatcctcctgcctcagcctcttgagtagctgggactacaggtgcacaccaccacgcctggctaatttatattttattttttagagatgaggtctcactatattgcccaggctcccaggctggtgtcaaactcctgggctcaagtgatcctcccacctcagcctcccaaagtgctggtgtaggaggctggatctccataaaccctttgctgtaatgaggaatgtataagttaaacattaaagcagaagtagaaaacaatggataacgaactggggtaactggtgcctgagtaagaaagctcgaatgcaaaaacaaacccattaaaaccttacctggacttcctcaacctcaaacctgattgagggatcaaagcgtgcaccaagacccacttaagaaactttcctacccacagacccatagttaaaattagattaagaaacactcccacaagtagacatagagcttgaattgtgtatataagctaaaggaaaacttgtaactttgagttgatctggtgagttactctgaccttcttcctgtaactggttgcaaaaataaactccctcctttcccagtctgtctgcatcttgttattggactcgagaacaagcagccagacctcatttgtctgggaactctgggattacagcccaggagattattttttatatttgtatttctatcgtaggaccagttgcacttcgcctgttttataattgcatgtatagttgtcttcacttcctgattgtaaatccctatgggacaggagtccaaccctaacatctttctattcctcatgtgacccagcacatcacttagttcatgatggactgggacaaattaatccattccatgttttcacctgcttaatgctatacaatgctgaaatgtgatttagttagttattattgtagtcctttctcaccttttaaaccattttccataggaatttccccttaaggaattaattcaacgaagcagtagtacaagttagtgctctagatatagggatagatattaaagttgatgatgattagatgacatttttcttttttttgttttaaatattcttttttaaaaaaagtttattttaggtttgggggtacatgtgcaggtttgttacataggtaaactcgtgtcatggaggtttgttgtacagcatattttatcacccaggtattaggcctagtacccaatagttgccctttctgctcctctcccttctcccaccctccaccctcaagtagacccagtgtctgttgttcccctctttgcgttcatgagttctcatcatttagctcccacttgtaagtgagaacatgtggtatttggttttctgttcctgtgttagtttgctgaggataatggcctccaactccctccgtgttcctgcaaaagacatgatctcattcttttttatggctgcatagtattccatggtgtatatgtaccacattttctttattcaatctgtcattgatgggcatttacgttgatcccatgtctttgctatggtgaatagtgctgcaatgaacattcctgttcatgtgtctttatggtagaatgatttatgtccctctgggtatatatccagcaatagaattgctgcatcaaatggtagttctgtttttagctctttgaggagtcgccatactgctttccacaatggttgagctaatttacacccccaccaacagagtataagtgttcccttttctccgcaaccttgccagcatctgttgttttttgactatttaataatagcaattctgactggtgtaagatggtatctcattgtggttttgatctgcatttctctaatgatcagtgatgttgagctttttttcatatgcttattggccacatgtgtgtcttctttagaaaagtgtccattcatgtcctttgcccactttttaatggggttggttttttcttgtaaatttgtttaagttgcttacagatgctggatattagacctttgtcagatgcatagtttgcaaatattttctcctattctgtaggttgtctgtataccctgttgatagtttcttttgctgtgcagaagctcttaagtttaattaggtcccatttgtcaatttttgcttctgttgcaattgcttttggtgtctttgtcatgaaatatttacctgttcctatgtccagaatggtattgcctaggttgtcttccagggcttttatagtttggggttttacatttacatctttaatccatcttgagttaattttttcatatggtgtaaggaaggggttcagcctcaatcttctgcatattgctagccagttatcccagcaccatttattgaatagggagtcttttccccattgcttgtttttgttagctttgttgaagatcagatggttgtaggcgtgcaggcttatttctgggctctctattccattgatctagatgtttgtttttgtaccagtaccatgctgttttggttactgtagccctaatagtatagtctgaagtcaagtaacgtgatgcctctgacatttttttatgttccctaattattaggaattgaacttctgtccagcctgatttaacatatgatgatcagtatgttccagaaagatctgttctttaatcatcttctgagcacattacaagccattgaggaaagctagctagtgctaaccttatgaaatatttatggaattattattccttatttttttgtaagttaaaatgctccttgctgattaaaaaaaattacccacgacttttttgtgaatgggattaatcttctctctctctgttccacagaccatgactccctgttctccacagaggccaagctcccatggatatggggtggaaatttggagacaggtcaaagtcatatgtatcccaagagtcttgttcttattttctctatttgagtttactttgagctttcttctcttcaagtgtcagttcagctgatgtactggctcagaccataaccctttcccaaggactaggtaaacctggattactttctacctcttcccccttgttgacaagcagctggtgtttgtgaaaaagcattgtcttagtgcttgaagtctgctgccttagccaagttcagagatccattcattatctttgaagtgcccagcttcctaaaagggtcacacatgttgttaaagagactccctgagaacatacccaaaaagcaaggatgagggaggcataaacagcagctccaaggccaatttcgggagtactgagaacattttcttcctcgtgcctctaaagaatgagtttcctacttttatgtatggttgctctgaagaggcgccaaatctgaaatcccctgttttatgaggaaattattttcatttacataaacaaaagaataaaatctccaaggccagaactgatggttgctctagaagaaatgcctttggaagttctacaataagccccaggttcacgtgaccgttaggatactttgcatgtagtttctcccagtccttgtaaaggcataatgtcctcacctttaaaacccaatctacggatgggtgcactggctcacacatgtaatcccaacgctttgggaggccaaggcagggggatcacttgagcccaggagttcgagaccagcctgggcaacacagggagaccctgtctctacaaaacaaattttaaaaacttagccagggatggtggtatgtgcctgtagtcccagctacttggaaggctgagttgggaggatctcttgagccctaaaggacgaagctgcagtgagccatgatcgtgctactatactccatcctggataacagagtgagagcctgtctcaaaaaaagaaaaaaaaatctactatagaaatcatgaaaaactcctttctgtgtctccctgcactgttagggaactaataattcaagtgaaataaaaaacaaaactcaaaaaaagaaagcaccattaattaaagaaaaataatcactgcctaaaattagccaaagtgccaatgcagagatttctgatgtgaaaaatgccaataagagcagaaaagagtatttccatgcccctgcaatctccttctgtgaggtaacatgtcccacgtgcattggcatagctttgcttcaccttgttcccatttctcacagctcacacccagccagatggactcctctgtcccccagcctgataaaagcaagggtgacttgccttgctaaatggtaaattccttatgcaaagccttccagttctcaccaggcaggtcctcctctcctgtgatcagagagacatccccatttccctgatttcagagcagtgctatttggcacttctgagcctcacttgaacagtctggctgttcctggcccagactgtttactgcacccacatctagcaccttctcaattcctcttagcactcagaaaaattgtcttgtagctgaactcaaacacacagtaatacttatcctaagtacccaagacacacacacgagaagaactagccctacactagcgtaagaggagcattctattccaggttcagccttagggacgacactagagaaaataccaaaaatgggagaagaaacacgaaatcctgctaggaagctgagagaaaatctgagaacactcagcaaagaatgcatgagcaaaggatgggatagataacagacagcttttcagtctctagacatcacaaaacggctcagaaaatgaccagaggggccaagctggagaagaggaaaacactgagaaagagcagaaggagctcagttatgcgcggctggctaacgtctggggttgtctgccagggagtcacggtggctgggctgtgacaatgggagtccggggcctggagggtaaaaacatacgcaagtacaaacgccagacgcccgccaagcagccatcacgccctgcgctctgctccacggaagtctgaagggggctattcgcacacagagatcccttttttcaacctcctccttgcccgcttaaagccaaaccgaatgtcttaacagagaggcaatcggaccagaaatgagcaaagggcggctcccaagttcgagggattttagataagacccatgcactccagacacagagccccatctccatacagaacagtcaagggcaggaatgaggagggcagaagagggacagggtgcaggtgggagatgactgccctattttatgaaaatggaaagcagtccagaaggagaaccgcgatgaccctgtccacccccgcgtgattgaagtggtggcggtgctggtgttatcaggtgtctgtacccttcacccagaaccagtccgctggattttctcaattccccgtgaatactggcacctcccaagtagtacttggtctctcactccccaaaaagacctacgaacataatttcttctaatctgtccccctctcctcctttctaactttccaccttcctgtcttcctaatcatctgagtatctcctactcaaaaacaatgttttaattgagtgcttctacctagggagttttttttaagatacctgtaccagactccacgcccagaccagtgagaaactaggagtgcagcccaggaatgggcatttttttcgacacacccagatgagtccagtgtgcagccaggattggcaaccactggataagatcctgcaggacagaatccttcctagaggccagtacccggtggctgaggctctgcgtgtctgctgcctatttctgcagatgccccgctatgaaatcttttccaacctgcatagccttctggagactgaataaacctctgcttggtagctcctggtctaagagggtcaccctatactgcactgtcggaccccacaggcactttccagtgccgtcagcctggcctgaaggatttgctgggatttctaaagtgtaaatcttttccttgggcagagtggtgcttaacacttgtctggttctcagggagctgaagaactttagtcttctactaaagacccaaggtgttaagtctcctggtcctccttggttgtccgagtgtacagggaacagcagaactggccccattgtagcatcctcccagggagttcaggcctcggccttcagcttcgcaaaatgttttcaggaggaggtttagcaagtccaactctcctgaagtagaagatcacttgggaatctcttacatcctcttccccaggggcacatctatttcttcttctttttttttttttttttttgagagagagcctcgctctgtcgccaggctggagtgccgtggtgtgatcttggtgcactgcaacctccgcctcccaggttcaaacaattcttctgcctcagccttccaagtagctgggactacaggcacgtgctaccaaaattagcctgactaatttcttgtatttttagtagagatcggttttcaccatgttagccaggatggtctcgatctcctgacctcatgatctgcccaccttggcttcccaaagtgctgggattacgggcatgagccaccccgtgcccagccaagcacatctatttctaagcagattgcaattcttgttagtcagcgcagggcctatggatagagactaagctttaaagatgggtgagcctccccttacaggtagttcaagaaacccttcctgatgtctgaggataccaggcactgggttagtatgtaggggcctgagagtgggcagggactccaagatgaagtgtcctagccaggcttggtggttgctcacctgtagtctcagccactcaggaggctgaggcaggaggatggcttgagcttggactcctgggagtccaagaccaacctgggcaatgtaacaagatctcatcccaaaaaaagaaggagaaatttcctagggaaactcactatctaggcttctaggaatcccagaatcaggtgtgaccatccacgtggttagcaataagtttcctatgggaacttcccacccaattcagtgcttgcagaataagaaagcgctagcaaaaacatttaatatcttgtatttaaggtgagtcatagtccagacaggacaggcccatgagatgtggaaaaaatgtgtttccaaggctatgttaacatcactagggagtttcgtctcgggaaagcactctctataaagtcagttcttccaggtcctcaaaccaattcaaaacctagcctgctgattcaacttgtgtggacctcagccagtctggtattaggatgatagtgtaggtattccagcttcctaggggagctctgctgaatacgttagctcatccctgggcaatgttgttggcacagccccatgttacctcatctatcacatggttaccagagcgagctcaccatcttgcacacctgaacatggtttcaagtccttcatggatttgcttcatggcagtagcagggtcccttcaagaatgacaccagaccacatgtaccagaaccaccatgggcaagaaccacaccctggagtcagactctttgtcagtaccccacttttttttaatgctagacccatacaaggaaggggacaagaataagaaaacatcatcaagggccaggtgcggtggctcacgcctataatcccagcaccctgggagcccgaagcgggcagatcacctgaggtcaggagttcgagatcagcctgatcaacatggtgaaactccatcactgctaaaattacaaaaattagccaggtgtgatggtgtgtgcctgtagtatcagctactctggaggctgaggcaggagaactgcttgaacctgggaggcaggggctgcagtgagccgagattgtaccactgcactccagcctgggcgacagagtaagacttcatttcaaaaaaaaaaaaaaagatagaaaagaaagcatcatcaaataagagatttgtttgcaagcaaccaacacattgcaagaagcaactttctgtgcatgttctgtggtcaattcaaaattacagtgataattgtgagatatcacaagattgacagtcatcgtagtgagatatttgagtactatgtccacttgagaaaaacagacttcatgctccctacgaagattctcagcatcaaagattggacccaaaacgaggtgtcttattaatccagaggtaactagcaatcagccaggaactcagctcacaagacctgggcacgcggtcaccagggcagcattgtattgaatggtctgctcttagatggactggccctgcaaatacgtgcctggaagctaagcaaggccgtgctattcacttatctgctttacctggggtggggtggggacaggccaggtggtcagcagtgagctgatggaactccctctggagaaactagtgagagggagtgccaaatctgtcttccttccacccaaaggaccccacatagccttcccagggctaaaatgtcagctagacagtgcttgccttggcacttctggtctccccactggggttcagtgcctcctcatggcccaggtgatacctgaaattcagcaaatttaaacccaagtccaccctttccccttcttcaatccagcaccttcctcagaccgacacccctgcttctgttcatggtgcggcagcctcctggaacctttgaggctcacagcctttaagtcatgcctctctttcctacatccagtcagttactgggtagtgttagttcttcctgaataatcccccaagtcttccccttttctctatcttctcattgctgcgaccttgagttagagccttaatccccgccgtgtcccatcctgatgcggagacctccaaaatcatcttgggaaatgccactcgaatcatgacactcccactttcagagacacattggagggtgaggccccacctcatctgatttctgctgtgccctgcaccacacacgaatcctcttcccgagctggcccacatgctcactattcaaggcaggccagcgttttcctgcctctcctcaggcaggtccctgtctttcaccttccttgatgaaagtctaatttctgaaatgaaaagcaacagctcatacttactgaatgtttaccccatgccaggtactgtgctaatggctgtatcttgtttgatccttttgatggtctaatgactgggatactatcattccatttcacagatgaataaagcaggggaagtgaaataacttgtgcaatgttgcataactcaggagtggtagagcagaattcctgattccaagtccacgctccaaagtcactatagtctattacctcccagcattttgttcttactcttaatgcgctaagcctccccaacaccaccccaacagattatatttagagaagaggaagcagttcttacacacttttgccctaaacagtgtttggcagggtcccattattataaactattggttcttcattcacactaaagtggaaatgactaacagtagcttccataactagatgaatttgccttaaactaaaagcctgagattaaatctggcctatgctgcttaagctgttgtactttcttctcctcccctgctgtcctcagccagtacccctgagaccgtgtgctagattcccataccagggttcagctgctacatcatcccgcctctggaagttccctaaatgacttgccttggcagatggctctgctctttaattagccatacagttactgcttccccttatttaatatcaggaagcttccacttgtttcatccccttccccatcttggccatagtgccttcctactattcttttcccgttttgtacttttgtgtgctcctgttccctttaatgtgttatcagaatctcatctcaatctagggatttttgccaagttgtctgaactctctatctccatatgtggtatctgaggtccttcttaaaccctgattttccccttatttggtattaatgcacacactattttcaggacccagcatcaagagtcaaggtgagtgttgtttgcaaatctatcataactcggagaagtccccatactcaaatgtcttagccatgttagcatgtactcagcaagaggccatgaacagtggctcatgcctgtaaccccagcactttgagaggccgaggagggaggatcacttgaagccaagggttcgagaccagcctgggcaacaaagcaagaccctgtctctacaaaaaaaaaaaaaaaattcttttttaattagccgggcatggttgcacttgcctgtagtcctagctccttgggaggctgaggcagaaggacccatgagactaggagtttggagtctgcagtgagctatgatcgtagcaccattgcactcctgcctgagtgacagagcaagactctgtctataaaaacttttgaaaagccaggtgcagtggcttatgcctttaatcctagctctttgggaggctgaggcaggtggatcacctgaggtcaggagttcgagaccagcctggccaacatggtgaaaccccatctctactaaaaatacaaaaatcagccgggcatggtgatggctgcctgtaatcccagctactcaggaggatgaggcaggagaatcgcttgaacccacagggcagaggttgcagtgagccgagattgcacaacttcactcctgcctgagcgaaagagcgaaactctgtctcaaaaaaaaaaaaaaaaacttaaataaaaataaaataaatgttcagtgagaaccataatgtgaatagtataacccagcatgattttggtgtgaggataattgataatcattttcttccagcagacctacccatctcggtgggatttgcttcaagtgatgtatattcaaattaatttgcatctcctggtcatatactaattggttggtgagtggttagtagccaagaaacactgcttatggcaagagaaagtcaagtgaaagattaaagaaaatcatgattaataatctgccagctgataaataagatagttataacaccactttggtgaggtgtacgcttttggccatgtgtacactggtgcattttcaagacagtggctatcttttcacttctgtttggctaatcatgttatgttgttctgaagttactgctgccctatacccacttcacacagcctgagctctgtctccttccaatgaacatgaagatcttttgattccgtagttcctggttctgttctgattccgacaggatgctggcatcctcaattaggccagctaaggaaagcattagaaaacagtgatgcactacactctgtggaacttaccgaaaccaacaggattttagagaagaaataagggggagcctgaagctgtcaggccgcaaaaaatgtcaaagagaaatgaaacttcagtcttagaatgtcaaataaagtgtgataagaaataagaggagggaagatattccaagtaggtaagggcatcagcataagcaaaggtgctggaaggggtaatgaacatgtaatggtgggtgagcaggactgctgggagcagacagtgagtttgggtagaaatgacatagaagagtgaattggtaaaaatggaagagatgatgggcaaatgagaaagcaacgaagcaaaaaatatatagtacaatatgatattggaggacagaaatgattattgggggtaatttgacttttgaccatttcccaggcttaattcaagtatatttagctttcaaacatgacttctcctaatatcttctacacagctctttcagatgaaaaaaaaattggctaactgggtaaagggtgatacctttataagctctatttttttaatccctgaggaagtgaaccatgttatgagtcacatacatcgtgtttaggtaggtgaggaaatgcattgaactgatttgcagagaatgagagctccagacccagacagtgagacttcagaacttcatagatgtcaaagcatctttgacatctatgtcccagctctaggacacattcatgataggttcacttacttccaaacccaaagaggatattcttagacacttcctagtttcttcatcttgtaaaagtggttaagtggcttgtccaaggtcttttggctataaattgtagacaaggattcagagccaagtgttctgtccccaagaatgcttttgtctcttttttttaaatagtaacatcatgaggacatctcaggtcatggctggggagtgctttgtgctctgtaagggactaggaaattgttcacatacttcttcaatattgttcctgctgtgctttttataggataacacattttaactctgtcctcactaccaagactttatataaaatcagctggaatgaattgctggtcaaattcaaaattaatttcatgtcaaagtcttttcctcatgatatttgtgtgttttgtgagaactgcctttcttaaattcttctgaaccaactcataatactccaaatttaaatccatccatctataaaactaccttttctgtatcagtagtactttttcagaacatacctatttctagattataatcaaatattcttaaaataatctggtagtctgtgagtcctttgtctagaacttaattaaaagtggcaaaggaggccgggcgctgttgctcactcctgtaatcccagtactttgggaggccgaggcaggtggatcacgaggtcaggagatcgagaccatcctgggtaacacggtcaccccgtctctactaaaaatacaaaaagttagccgggagtggtggtggatgcctgtagtcccagctacttgggaggctgaggcaggagaatggcgtgagcccaggatgtggagcttgcagtgagccgagatggcaccactgcactccacactgggcgacagagcaagactccgtctcaaaaaaaaaaaggggggcggaggggggcaaaggagaagccaggcatggtggcttacacctataatcccagcactttgagaggccgaggcaggcaggttgcctgagctcaggagttcaagaccagcctggccaacatggcaagaccccatatctaaaaaaatacaaaatttagccaggcgtggtggcacacacctgcagtcctagctatttgggaagctgaggtgggaggattgtttgggcccaggagattgaggctgcagtgagccatgttcgcaccactgtgctccagcctgagtgacagagaagacccagtctctaaaaagaaaaaatgtagcaaaggaggagtatgcagacttaggtggagattctgcaggagacttctaagtacttttaaggtgatatgattcattaaattgaattttaatttactttatttttaatgtttattttttatttgcataaacttatggagtacaaatgtaattttgttccaaggatgtatttcatagtagtgaatttttgttttcttccaaggttagaactttcttcttccttgctataacttccttcaggatctggctatctttcttcattttttctttcttctccttctccttcacctcctctgtattagactgttcttatgctgctaataaatacatacccgagactgagtaacttataagaaaaagatggttaatggactcacagctccatgaggctggggaggcctcacaatcatggtggaaggcgaaggaggagcaaagtcacatcttacatggcagcaggcaggacagcatgtgcaggggaactgccctttatgaaaccatcagatctcatgagacttagtcgctattacgagaacagcacaggaaaaacctgtccccatgattcaattaccttccaccgcgtaccccccaacccatgacacatgggaattatgggagctacaatttgagatttgggtggggacacagtcaaaccatatcatcctctctcccttctttcccttcaaggaatgttcaaaaagaagagaccctctaaggaatgatcaaaaggaagagacactctaaagttactgagcgagagttataaaaaatagggaaggcaagaaaatgaatttagagggttgagaaggatctaaagagattgaatgagaattaattgagtgtgtaaggtaaaaggaaagtggggtagcctggtttgggtacagtcatctggatagaaaaatgtaggtagtccaccttgggtggacatctctttacatcaggcagcactgcagatgacttggttgctttctggagttgccgagggtgggtacaaggcagagggaggcagcgcacagtcatttattctatgaacaggatgtttgctagacagatgtttgagcagtctggagctcttaatggaacaagggcaaggataaataaataattggacctatcctgatgtttgtccctatacatttaagaattctgtgacctgttttaaacggaatccaaacactgagtatgagttagatgataatgttgttattacccttgacctggccttgaggactgattttgagctttctgtatgagaaaattagctcagagtgacctaaaaatttctttattcttaaaaacagaaataaattctcgatctgccttgcccttcttggaagaaaggtagagtggaaagagttagaagttatttggtacagagtcattgagtagagtgctctcctgaggtagaacagaactgtcagggattgaattgcaggacagacctgcaattcaagatgattgttggcagtgaaattgctgatcaatggaatgtgtgggatgatagttcttgagagtcggggaggagagtgcagcattgttggggctggcattgtatccaccgaaaacattttcagcatctcttctcttctatacaagacttgtcctcttggtgtccctgtgggtcaccattaagtcgcttgcttattctttctcaccatgtatcttcatttacctttctctaaaacttctgtaatttgcttttatcaagagattttggtcgcgtgcagtggctcacacctgtaatcccagcactttgggagactgaggtgggcagatcacctgaggtcaggggttcaagaccagcctggccaacatggtgaaaccccatctctactaaaaatacaaaaattagccaggcatggtggcgagcacctgtaattccagctacttgggaggctgaggcaggaggatcgcttgaacccacgaggcagaggttgcagtgagccgagatcacaccattgcaccctgggcaacaagtgcaaaactccatctaaaaaaaaaaaaaaggagtttttccattccctctgcatattctgggggaatttccagaccaggtaagtggtaaagaaccaatcagagcttagtaaataggtatcctactgggtatcagctctgaagaaagtactggaaagaatgttgaatccctacagattcttccaacacaggaagtcacgtggaggccaacccgcctccatgtactctaagaggtctgtttggtcccttgaatattacactaataatttattgatgtgactttcctttgcaagagactgcatctcaaaaccaaaaggccgttctgtagccttatttcttagcactttccagtttacgtattgtttgttaaacttttcattgtgttagtaaacccagcatttgttcaaggatatttgaaatagtcaaaggtttttgtaaatgttgtgcagcaaactggtcctaacagcccctcctctgcccttccactacatcaccccagcaggagtcagtggatattatagatttttgtggtatggaagtcttgtagaattctagaaatagcctggtggcaggattgacaaaatcatttacattcttagaataatccaaatgttgactcagcctgtttacctaaggtattccaagcattgggagagagaaataggaacccatgatatgatttgtcctaatattgaatcccctgacgatggctgtcattcaaagtattcctgggttcaggtatttttaaagaattcatggctgggcactgttgctaacacccataatcccagtactttgggaggctgaagtaagaggattacttgagcccacgagtttgagaccagcctagtcaacatagcaagactctgtctctacaaaaataaaaataaaaaaagaattcttacttgtcctagagtgttctgcttcttggaatagtaagatgattgggggggaacagatatattagatctgccctctatttagtgcttcaactttagtacaattaatttctaaattatgccatagttattggtgcaaagatagacacatagaccagtggaaaagaacagagagtccagaaatagacgcacacatatacagtgggtcttacagatttccacaaaggcattattatgattcattaggaaaaagatggtcttttcaacaaatggtgctgaagcaattggatgtccttttaggggaggaaaaatgaaacttgacctctgcctcatagcacacacaaaaattaattcaagatggagcaaaaacttaaatgtgaaaagtaaaaccataaagcttgtagaagaaaacaggagatcttcatagccttgggctaggcaaaaattttcttaaacaggacacgaaaagcactaaccacagaaaagaaaacttgataaattggactatactaaaactaagaacatctgttttaaaatcccatgggaaaaatccatagcatgtcttcaagatctctggcagaaaatcaggctggaacttgcccattagcactccagaatctgccccctgcccaagaccgatgaccctgctacctgtattggcaatagggagatggacacaggttaaagtaagtaggttttggcagggctgaggccctcagatcctcacaataaaattgtcttgcattccttgtgtggtttggatatgagagaagcagctttgttcccgagctccccctcaaatctctgaaaactggtatgctcttctcagaacaatcctttgagatcccctgagctttgaagtcctcctgccaagtctgtgtgtgggaaggagaacagagcagcatgagggccatcagagaggtgggcgaaggcagttcaaagcccagccagatccggctctgtggtgtccaaacccttggggtcccatagccctagaggaagcccgggatagggtgaggcccagccctttgcagggttctgtattgctgcatccagactaggaaatgtctgagacagagccagaaacgtaaatactgcaccactgtgctcaccacattcatgtttgcagcagaagagccaagccccctggccaggatatatgcttcctattcagacctatggtttggagggaaggaagcatgaaatgtatttagagctttccaaacttttgattgttttgcacattcctacaaaaataaaaatatcccatgagattaaaaaaaatcagcttctaatgctttagatgagtgggaaaatcttgcacactggggtcatttcctttctgtttcaagaaattaatattgtgctggaaatagcctgttgcagaaggggagactttatgtcctttgaatgctgattatgccagaaaactttccagtcctaaaggggaggttgtccctttcccaggactctgatgcaagatgaccctgcagtttgtactttgctaggataggagacccaagtcagcagagatttaaaattcagaagggatcattaatttattcattcaagaaaccatgctaagcatggaataagagccaggttaggttctggagtctcacactgccccacatgaggatcccaggctgccagctccatgaccctcctctgcggacggtcccaagtctttctgaaggcccctggtgattgaaccctggcattcagaattagcagaagtgacacactaattaccagtaactaaaaagttggtgttcacatctctattgcagatgccgggaagccaggccgtcaggggacaggcgcagtcagcaagcacccgctctctcggtatctgttggcttccacagttttgtgtttcagagccaaaccagaaatcacccagggggttacttgcatcagctctggaaaatgtgtaaaggattgaagtcctgagactttcccataatgtcttatttaggcatcagtctccctcagttgattagagcaggaatcagcaaatttctttataaaaggccagtgacagtgactattttagccatacagtctcagccacaactgctctagcagccagagaccacaggaaacaaataagtgtggctgtgttccaacagaactttattttatggacatttcctttacaattttcacacgtcatgaaatatccatcttttaattttttttcaaccatttgaaactgcaggccgggcatagtggctcacgcctgtaatcccaacactttgggaggccaaggtggggggatcgcttgagctcaggggttcgagaccagcctggccaacgtggcaaaatgctgtttctactgaaaacacaaaaattagctgggcatgcacttgtagtcctagctacttgggagactgagtcatgggaattgcttgagcttgaacccgggaggcggaggttgccgtgagccaagatcatgccactgcactccagcctgagcaacagagtaaggttctgtctcaaaaaaataaaatttttcttaatttaaaaaaacaaaaatccaaacaccattcttagctcataagccatgcaaaaacagatggcaggccagatttggcccacaggccatagttagctaacccaggaccagagagtcataccactttcatagcaaaaaggatacacatggtttgtgttgactctgagtagggaacttctccagagggtgccatgatacagaaggtggggggtgtgttccctaattgggggaatggagaagcatcactctggcctctctcagtggccccatacctgctgactctatttaggccgtggcttgagggtgccccccacttgccaatgcctcctgccagggacctggacactgagaacgctgggaaagggccctctccttggggaccctggtcacacccaatagatcagtcactcttcttccttcttaccagctgcctctcctgagcacactggaagaaggacccctgtaccaccttcctcgacacccgggcctcttctgttcaaaggtgcctcctggccaggcatggtggctcacacctgtaatcccagcagttggggaggctgaggcaggagaattacttgaagccaggaattcgggaccagcctgggcaacatagcaagaccccgtctctacaaaaataaaaaataaaaattaactgacatggtggtgcacgcctatagtcccagctactcgggaggctggggtgggaggatcgctggagaccaggagtttgaggctgcagtgagctatgatcaagccactgcgctccagcctgggtggcagaatgagattctgtatcaaaaaaataataataaaattaaattaaaaataaagatgtcccttccaatcccctgacgcacacagcactccacatgtttcttttcttccctgcctcatcacccttttcaaccttagatcctaagcttcttgaagcagagacttccatcttgtctgggtgcttagcacattttcaaatattctcttagattttttttcttcattacccatggagcggttgcttgttgcctttccaacccaaaatagaaatagtggtaaacaaaagaagaaaaacattgaacattttggaactaaaattttattactactggaaaagtcccagataataaaaaaacagctggtaaattagcactcatttaagcatggtctggggaagaagaaaattttaataacacatttttcttcctaattgtttttgtttgtttagatttatgcattcccaaagtggaccttaaaatcatgttggtggcaggaggaagccagtgtggtctttgaaatttgcttcagataatccatcaaggggatggcctcataaacaaaattattattttctccctaagatgctgactcatgtgaaggactgtttaaaagatgactttggctttgtgccctctcctgcaggtccttccatagtgacgccccccaaggacatctggaatgtcactggtgcccaggtgtacttgagctgtgaggtcatcggaatcccgacacctgtcctcatctggaacaaggtctgtggcacagactttaagagacatcctaggctgacaagcttctcttgcactgcacaaggatggtaaaacgttaaatcctcagcctgctttgttgactgcggctcccgcaaggtgaagccttagggcagtcatacaggcccctcccctggattcatggaacaaaaaccagtccctgccatgcttttgttagcagcatcctagaatctgagaaactggaagaacaataatgctgaacacctgaacccaccttcagggtgtgtgtgcacctgtggtgtgtgtatgtgtgtgcatatgtgggtgcgagtgaaagtgtgtgtgtctgtgtttgcgccctcagtggagacagtatagcataggggttaaaagcgtacgtttctctctttctgtcccaaaataccacctccaagcccccaccaagctgtttgtgatggcatcagtctcctcatttaagactgaacatttagctgataatttagatcctgtctgcttggaggcattattattattttactgggaggctcggctaagaaggtaaaaggacacaaagccctgtagccttctcctgggagcatggattattttttcagattccctaagtgctgggagatggatgagtacattttaagggcacttggaagtaggatagaaggagtgaggtgggatctattctcctaagtaccaaggctgtagaaccataagttagggacagaggagaccactccagaacagagcattaaaaaggaacaagaggaggaatagcaaagaaaaaaatgtctcctttctgaattttgctaaatgctggccccagccccaagtggaaaaagcatgatattcttttaataaatcagctttgaaatgacttcccaaatggaaaaaaagaaaaaaaaagtgtgaggctgggtgcagtagcacatgcctgtaatcccagcactttgggaggctgaggcaggaggatcacttgagtcctggagtttgagaccagcctgaccaacacagtgagacttccttcttacaaataatttttttaattagctgggcatggtgaggcatgcctgtggccccagctactcaggagactaaggtggaagaaccccttgagccaggagattgaggctgcagtgagctgtgattgccccactgcactctagcctgtctcaaaaaaaaaaaaaaaaaaagaatgtgaattccttagccagggtggctgagttctctgcaagtcagggtttctcagcctcagcactattgacatttggggccagataattatttgttgtgcgggctgcctgtgctttggaagatgtttagcagtatccccagcctctacccactatataacagtagcattcccccatcccccctgtcgtgagaattaaaagcatcttcagacattgccaaatgtcccctaagggtgtggagctggggaattgccctggactgaaaaccactgctgttagcctcaactctgttctctaccttataaaagtagcatgtaattatcataaagatgaaataaagtaatgcaagtaaaaatcacttgatacatagttagcactcagtagacattagctactgttcctggaaatttttcccttcaagtggcattatcttgtataattatcttcatatttgaaggacaacatcatctcagcatgtatggagaagggaaaagaaaacacttatttgccatcaactaacacctcacaattataccatacacttacgtttttgtctttttttttttttgagacatagtttcactcttattgcccaggctggagtgcaatggcaccatctcggctcaccgcaacctcgcctcccgggttcaagtgattcttctgcctcagtctctcaagtagttgggattacaggcacccgccaccacgcctggctaactttgtattttcagtagagacagggtttctccatgttggtcaggctggtctcgaactcccgacctcaggtgatacgcccaccttgccctcccaaagtgctaggattacaggtgtgagccaccgcgcctggtcgtttttgtcctttttatacattttgaattgctgagcctcacaactatcctacgaaaaataaaaattaaaaaattatcaaactcatgctaccaaaaaaggaacttagtttaagtaaaagggcataaccagacatccattttaagctgccttacttctccagcaagctctaaggtggatgatagtctcccttgactattttgtttgctctctgtgtgaccggagaagcaacttctagaactccaggaggactgtggctcccgcagtcggagctctttctgttgcaagttctaccagcccatttgaaaccagcctaggcaaaacaaaaagcggggcgggatccagcctcaagggcccctgcatccaggtacacacgccatcagaactctaactcttgactctttgctctcaatatactagtctcattttcttctgcttcagaaagcttcctatgcagtgggagatatcaactccactcacatttttattacagcttaaagaccccagaggaaagaaagggcttcccttctccctgctgcattgtgaaaatcccacgaagggctcaagcccaggtcgggtcacctgctaagctctggctcccccatgcggccggagggatgcggccactgacattggcaccggcgtgaatccgcctggtttgtgtaaaatctgggaacaggtaccagaaaatgcctgaggtgggggtgatggcagaggcaacactactataccatcctttacagtgaagcttctcttaaaggagcaataaaatttcaccccgatcagttatgtttttaagaggaaggcggagcaagagtaagagcagaaatgcagtccgtggatgggttcccctccatccttactgcaagaactgcaggcgttcctcactgctaatttggagattgctggtttgctcagggtgtggggaggtggagaaataatgttccgaggaatacccatgaaaagctccgttgcagttctctacagttttctagggatacttacccaatgagaagcgagggtcacccaagcgtcctggggcatgtgaccttattggcaaatcttggcaaagaataatttcttcagtccttgctctacccaatcccagctacagtattcacataccagaggaatacgtctgcctcgggaatcttttcccttttaggactgtacagggcagatcccaatagacaaggcctccctgagggcttgtcctcagggctagtcagaaacaccaaggcagttgaggctggtgtggtggctcgcacctgtagtccctagccactcgggaggctgaggtgggaggatcgcttgagctcaaaaggtggggctgcagtgagctatgatggcaccactgcactccagcctgggcaacagagcaagatcctgtctctgaaaaaaaaaaaccaaaaaacccactatgtcagtcaacgagatgggtgctgaagtaaagaagtgaagaggaagtaggagagaaacaattttttctgcagactttccagaacaagcaaaacccaactgtgatgctctgccggttttcctctaccttcataatgtaatttgccacatgcatgacccaaagcaatgtttcttacactgcagaccatgacccatcagtgactcctggaactaatgtagcgatcacaaccaccatgttcttataaaaaataaaaaatagaacagaacctatgttaaggcatcacacttaccacttatgaaggtgtcatttcctaaaacttttgtatattccagatatacgatagtttggtccatgtcaaaactaaggaaacttgggaagtcactgacctaaataattaaacagggtatttgttttctcatcgctgtccttgtaaccagactgttaagaatacaaacatatttactatcatgtgtgtttcaaatccaatttaagagtagaacacctttttggatagattattagaatcctcacttgtaaaacaagagaaactgaggctcaaataaagacagcatgtccttcttgctcaaggtttcttagcaacagcagaattaatggtacaagccttttctccatgacacttgagactacggtggcaattcttacggttggcacagcctggcgagtggtctttactttccttactggtagtaaggaaagctggctttaacaagccccatacctttcagcaaactcctagcctagaaagattcgaaaggcaatattttgaaatgggaacgtgaactgaaatagccatatttgacttaacccttttaaatcaaagatgatgctcacagcgaaagcaaaacaccttcccaatatttgtttctgagacggagaggctctctgtttaattcttttcttgcctgaatatttcttcagattagggcttccttgacctctaagaatattttttaatcaaaaatagtgacctctaaggtaatagtaataagcagaaattatccaaagacgtataaagaaagagttgagaatctccccccacctcctcctcctgcctgaggtaaccaatgtgaactgccctggtttgtatctttccacactctttttcatatccaagcatattcaaacatatatccctacggtgaaatgagaatatagtgtgccagtaaattattctgaaactcgcttttctcaacaaatacttcatggacatccgtccaagtctgcttctcaacagctacgtaatattccaagtatgaatactgtaatttattaaatcagttctgtattttttctgttgtttccaaatttttgttaacttaaaaaacctactttaagcatcaaagtacacatatcatacatactagtgattgtattgctataagatagattccccaacagttacctaagtcaaaatatttgtttcagtgttaacagacattgtcagattactttctaaatagattgtagtaattcacactcccaccagaaatggagaagtgccatttctctgcatctttactagcactgaatattaacctctcttttttagttttaattccaattttaactagaaaacacatatttattggccaggcacagtggctcatgcctgtaatcccagcactttgggaggccaaggcaagtggatcacttaaggtcaggagttcgagaccaccctggccaatatggcaaaaccccgtctctactaaaactataaaaattagccaggcgtggtggcacatgcctgtaatcccagctactcgggaagctgaggcaggagaatcactggaatcccggaggcggaggcagaggttgcagtgagctgagatcgcaccactgcactccaccctgggtgacagagcgagactctgtctcaaaaaaaaaagaaaacacatacttaacaacacttagaatccccttacacgaataagggagagtttgacatataaaaatttgtcatatgaaaattcttggcacttttttctatgttttctacatgatgtataaccttttataattacgtaacattaattaaaatacgccatgccaacacttgtgaaaagaagggaaaaataaagtatatctatattgtgatttctgttaaatattatatttaacaagatacatttccctttccatagtggatcaggttaattagcataaaatgctgttactaagagctatgggatttgaggcttagttgctgagattcagtatttcagtgctgcagtgtttattttcttgctttggtcacacataaaactcatatgattctgaaattcagtaaataaaggtcagagtcatattacttgagaccttggatcaaattaatacttctaccaaaatattcttacaacccatttttaagtaactatttcaaaagctgtattagcataaaccgtttctgccagctacttgggaaactaagggaaaaggtacctattgagtatgtttgtcttcacagcatttatgagaaagacattaagttacgtggttttctctcactaatagtggcaatgtgggaaaattccagaaaaaaaatgcaaaaagccaggctttccaaatcatgcaagatattttttctagagcaggaattggcctagatcacatgtggtttgctgaatcccagtcctggcatcataaagctgagaaaatacagtgtaggtttgaagccgacacaacagcagagtaccaaaaaacacatggtaggagtgggatccacatgggaaaagcaacactgagatggaagttaataaagtgtatatatttatttatatatttattatatttatacatacggtgtctatatatacacactattatctggtctttattaagatttgctttattatagaagaaaatgaaaaggaaactagctatttgaggttgtaaatcctttctaattacaaaggtaatatcaataaatgtcaggttggctcttaaaggagatctgggatggaatgaacaaacaattcgtatatccttttttttttaaaactcaccattatcacaaggcttaaaatatttgtactctgtaactcagctgctaaatgtatatgtatcgaggagctacaagtgaatttcattcttttgtatattttccagagtttatataataaaacattttgccttttaaaatgagggcaaaaaggatactattcagtattggccttgcaccaaagaaactgagtttcttctgaatcttgacatgacatacacagaaacagtcagcaagttttgtcataaaagaacaatgacagcacatgtatttgacagctgtttttttttttttttttttttgagatggagtctcactctgttgcccaggctgcagtgcagtggcgcgatctcagctcactgcaacctccgcctccaggttcaagcaattctcccaccttagcctccagagtagctgggactacaggtgctcgccaacacaatcggctaatttttgtgtttttactagagacagggttttgtcatgttggtcagtctggtctcgaactcctttgataggtgttttttatcttaggtgttcagtaaatcatttgattaattcttagccctcagaataaagtaatggtattggctttggtctcagcctattttccattgatgaagctgttgcaggaagagccccaaggtcccaagcatcaaacctagtgctgggtgacagttcatcagttgaacatggcatgacaggcaaaaggcctggaactgagaagcagaatttccaagagcatgagtgaatgaatgatggtgaccagtggcaggaaattatgaccatgtatattccccaggcatgcagaaaaatacattagtttaaaacatgtacgcttagcaggaaactggcaggaagaaataaaagaggatctatattttaaaagtatttaggaaagggaaatagttcagtaaaatgctgggtttactctgttagaaagtctgacatacactatgtgcaattgtagggatgtggccacttccaagtagatgatctggtgtacaaaactcagtattactctccttttgtttttgcaggtaaaaaggggtcactatggagttcaaaggacagaactcctgcctggtgaccgggacaacctggccattcagacccggggtggcccagaaaagcatgaagtaactggctgggtgctggtgagtaccagtaccaagagctggcaagagtttcattcttagcattagacataagcagacctggcaaaggtgcctgatgtaccgccagcctaaaggtgcttgctcttccacatctgtttggaatagccttaccatggagtcgctgctcctctttcagagaaactaaaggaaaagtgctttattgcatgttttgaaaacaaccaatgaattaacaagaactagtattttcctaagagttcaaagcaaaatcctcacacggagctgcgtggcccaagcattgttttaactgattatcgattaataaataccttattttacttgaccctggatattcatggagaatactttgatcatatacccttatcaaggttgcccttaaaccgataatgtgtacctatccagtttttaacctatgcagtatgatcaaaagttgtccatgacatttcctcatatgaatcctcagcaaaccaaatatggtagttatcgaagtctcctatcacaggacttgcactgcttctagcagtacctttgctatgaatcccctggtcatcttaggaaatttatgaaataatgacctcactggaaccactgacaaaagagaagaccaccacagaggaatactagatcttttttctttcacaggtatctcctctaagtaaggaagatgctggagaatatgagtgccatgcatccaattcccaaggacaggcttcagcatcagcaaaaattacagtggttgatgccttacatgaaataccagtgaaaaaaggtacacaataaatctcacagccatttaaaaatgactagtacatttgctttaaaaagaacagaactaagtatgaaagtatcagacgtagctattgatgaaattctgtagttagcaacccataagggcattaagtatgccattaaaatgtacagcatgagactccaaaagattatctggatgggtgactgaacatcgttattatgacttagatgcttttaccttatctaacatgtaagagtcaaaatcaaacttgcctggaatggcttctatttcccatagctttctacctatctacttggcattttccctttgtgttgtgactattaaattcctatttaaaagaaaatgattgtgggcaattctcgcccttcacttttgcttttaaaagaaaaggccacaaaggagagtatattggcaaatacccagttctgttctgcctccccttccttcactgccaaaaagcttcctctgaagaacccatcctgtgtcatagcagtgctactttacatttatatagttctatgaaactgatgtctgaattggctttcccttagacaaaagaacaaaatttaccgtcaccatgtgtcaaaccattccactgtgcagatcactcagctgtgatatgaaaagaaatattaagtaaagaagtatttggtcagattctcttcagccataatgtgtaatgtcaggcaatgaaacagaacagtagctaagagtcaagccatgcgtttgagtctcagctctgctactaattattcctccactttaccttttgaaggagatccggactacaaaggaaaggtctttaacctctctgaatctcattgtgaaatgtgctcttccagttctataataagatgtacctttgatgcatcaaccaatacagcaaaattgcctttcatagctaaaatcatgtaacttgagttccacagagcactccagcatatcatttatacaattactcatatatcctttatccccatattttaacatcttcatttatttggaaacactcaactacatgccaattcaaaagtcaaccacatccccatatgtaactaatttttatctttttttttttttaaacaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtacatatttgtcatttttaaaaagccacacaatagaaacaagacaccaagatatttaattatcttgttgactcctgtaaaatagctaaacactcatcattcgcggtgcaatactcatagacataagttcctgaaacaatagtttgcatgcgtaaggcattcgcaccaaagaaatctgaaaagaaaaaacaaatggtaattagcagaattgtattgaagtgaccccacttctctaccccagaaaaagacaaagatctggtactgtagataatgaataaatgagtggagctgagaacacacattctgctacctcagcttatggtggttctttctcctagtaggctttggtattttacccattctgccagacataatttatattcacccacctcaactaaaaggttttcaaaaactcattgtttaaaatcccttgtacaaagtcttattatttccaaaagatgaatagcttagagaaattaccacactaaaacctaaactggtttttagaaaaatcaaattatcttttccttatttagaactaggaatctcacagaagcatgctatcaaaattgtgaaaatgccaatctgttctgccacactaattctgcctggataatcagaccaacacagtttcctctaaacaaatatcaactgccagtaaagtctatacacacctgggttttattgcggcagcccctgcattcatatgtatgggtcctggtgttggcaatcgccattattccacaaagattgcaaacatgaacctgatatggatctgatgcctcaaacaatctttcccttaaaaactgggctgctccatgggcaatctgacaatctcgttccatttctccaaaacgcaggccaccatcactgttaagagaaaaaaattattactttgtacttattttttattataaacaccgccttgaataatggcaaaggtggagaataatatttgcaaagacggataactaggctctaatttttataccctagcattctctctattggtggggagaggagaagtctaccaactatttgacgtgcattagaaagtccccaaatgggctaagcaaagtggctcacccctgtaatcccagcactttgggaagtggactgggtggatctcttgagctcaggagcctgggcaacatggcgagaccccatctctattttttaacaaataaaaataaaaacagaaggtccccaaatggagtggatacattagattcttaagtagagcatttaattttcctcataagacacaataaagcatagagtggaggttcatcatgctatcatttaactttctagaattcaactctatactaaaaaaatgaataatgaaaaagacaatctaaataaggcagcttgtcaatggaatgactgtcccaggcaatcaaccttgaaatcataaatacatgttggctgaagtaatggaaagaacaggtaaatgataataggtttccccaacataagaagtgaaataaatgcattattcagatggccaggcaaatagatggtgatggcttccttaacatacttaatatccaaaatatacaaaataaaaccaatgggtttataatgatattccaccaaaacaaaaaaatcattggtcgactttggaccactgatctggatcattagacaaccagctcactattttgaaaactggtaaataaaaaaagagaatcaagcatttattcctgcccttactataagaactacatcactaggtaaccaaacagttgaggaaacaaagttttagaagtagtctggctaaaaactgaagaaggactgagaaaaaatagaatggtatcagttggaaatcgccatttaattaaggtctttagtaatagctgctaaaatcataaaaagaaaggcaaccagatactggaagtatagaataccacctataaagtattactgccaaaaaactcaaacgctaaatctcaagcctcaagatctatttacaaaaaacaaaaaacaaacaaacaaaca

SEQ ID NO: 14490 - DNA, 9434 bp, Human
ggcatggtgatgggcgcctgtagtcccagctacttgggaggctgaggcaggagaattggttgaacctgggaagtggaggttgcagtgagccaagactgagccactgcactccagcctgggtgacagaatgagactctgtctccgaaaaaaaaaaaaaaaaaaaaagatgactttgtaggtgacccaagcattatttatatgagtcctggcccccaattagccatgggaaacacaagctggaaagtgaaggctagctgaaaacgtggaaggagaaagagaggtcagaaggtcagctttcattcagggccacatgggacagagactagaaggggcccaagatctcaatcaaaagccaaattggggtggccaagtcccgtttcattgagaatctaggggagtctgcccagggcaagggccaagacaaggcaggtatctattatgaactggaccactggagggatctgtagacacaacaggatttgagacactttgcattgtgggggtcccaaggggtgcctcttcccctgccccaatgagtatttgtctcactgggccatccctcagggggactgggcaaaggtccctttccagtttgctagcagaactgtgatggtggtggtgaaacaaaccacaggtagaggcctggggattacttctgagctcccttcctcactgtcccctagcactgaaggctcttcctgacaagcacccaccgggagtgtgtgtgctcagagcacagagagtcctggagtcaagtcactcatcaggtgcctctgctggccagctgctggctccccaccttgtgtggaggtgtcctccctctctccactccccagctgggatggcagggccgtcccctgctctctctgaatctccttcctcagccaaacacattttcctctcttgaaggaagatggttaggggcaggaccagctacctaatttgcaggacctattgcaaatgaaaatgtaaagcccctggctcagaaattaagaatttccagacagctgcagcagagcattaagccaaacatgggacctttctgagggtggagttgtatgcacacacccacagagctagcctggggtagggaattcttttagctgtgcacagaagcctgcagcccaagggccctaattacactttgcagcagggctgtcttttactgttataagacattctgtgggagttgttcagacctgctgctatcaacacacccacagcatccttctctccactcctagcctctactgccctctgcttcttgaagggggctctgggcagccctgaaaatcacacagactggtggttctcagtgatgcatcagaatctcctggaggtgaaatacagattgctgggccccatccccagactttccgactcagtaagtctggggtgggcctgaaaatctgcatatctaacaagttcccaggggatgctgatgatccagggaccacgctttgaggccactgatgtaaagaactagagcattcagcccaggtgaacccggtcaccagagggctcgtcaggccacatcagggctggttctgacctgctctgaggctggctgccccttacccaagggatcgtgcagccctgaatcctcccactgctgatttcctgtctgtcttttcagtgtggtgaaccaggaggaaaagtcatttgccatcggggtgcagttcttgttgatgcgcttgctgggtaagtgtctaagacccctcttcccaagaagtggccccaggcgatggggcatctgaaggctatgggtgcagggtagcgatggaggaagcaccatctcatctccatggcgaagagaagctgtgcataatcaacagcagatgccaaaatccatgtggacggtttcccagattgcttgaggttaggaaagactccatctatggcattcattcctaactaagttatgtaagaaaaatgaaaagtgaacacagctgagaatacctaatagagtgttaaaggcaggtatttttaaatccttctcacaaaactcactgtaggaacaaaactttgcattcctgccaagccagagcagcggctgagcccagccctggcttcctttccattttacaaaattcactcctcctaaaactatttagcaaaagtttcttccctgtggggtcctctgctggtgagtcctgcctgccctcaagcagtccagagcccaccagaggaatggagctgtgcacaagtgatcagcagtgccccaggggagagcgagctgcttgaggcagcaggagtgctctcccggggtgcctgggctgagggctgggggcacaatgcaggcccattcctgaactgctcacactggctgttccttcttgacatatctgtgcactagacttaacacaaggcagcaatagagagatccttgtaatgacaggcacacagtagtaaagggacctaattgaactgaggatgtgttaattaagggtgcaaactacagaggggaatatggagactccagcaagaggaacttcagttactataaggtgtcgtttctgactataaatcctgaaataatggatagcccactgtgcctcattacccaggggccaggtcaacaccgcgccctgcagtggcttccatccccattttgagatgtattggtgatgtctctactggggccaggtgagcgggagcccttgctgagcccaatccagtcccaggctgggagaagtgtttggatgatgggaatgaaccagctttttcagtgggatttcttgttcctctagtccctgcagagccccttcagaccctgctcctgctgcctgcattataaacacagaggaagcagggcggcaggatctacctgtcctcccagcagaggctctgctgtcatcagagctccttattttcatttataacttaactttctctaacacttctgctgggaaagagacctcacattcctctcagcccatccagcacctaggataggctctaaagagccctttcctgcttcctccagcaaccttgaaaatgaccttgaaaacaaggactctctcggactctctcgcactgcttgaagcactcgctgcttttgcttttccatttgagctcagataactcaatgtgggaccacaatgagaaaacccaggcctggaggggttccatttatcacccaagaacacaatccactcttgggtaaaaaaaaggacttcctattacaggttttaaattacacattgggattgggttgacaatgtttccggactttgcttctacataaggaagtgtcatatatcactctggccagttttcatccccctgttcacctggagacttgagagtgagcaggatctgagtagagaggcttcttcttagagtttcccacttgtgggcagtgccacaagtggagcattgtctgtctttcttctggaagcagctgctcacagggccctaaacaaagtctgggaggctgttgtcagcactgtggtgctgagaatgggatgggccagccttggtgtaaatcctggacaagccctccgcagtccagtaactgcctagagctgtagctagtggtacgctacccacaggtagtgtggcatccggaatattagacagccaggaaggcatagcccctgccaagccaaatcttaacactcagctgctgggaagttcggggtcccagagcagaagctttgagcagccaggtattgggaggtctgcagaggggtgttgtctaatccaatagggcagcttggtgtggtggaagtacatgggattcgaacctccataaaccagggttccaagtctggccttgacttctcttggctgtgttacagtgtcccagccaagaaccccttcctcttcactaaaaagtgggcacccacacctcggggccagtgtgaggacctgagaagtcgatgcctggagagcctcctgccacacagtggaggcccgtgtatctccactctgagctgatctcaggagaactatgttggatgtctgagccggcatcaaggtgatccctgtgacttactctgacttgaaagaatggcccaggtcccttttgtcttctaagccttctggtgaaagagaaattcaggcttcactgaaagctattctgctttccagagtcactgtgagtcctatgggtacggcagagccgttctcatgtatgtgaactgtgtcggggacttggctcccacacccctgctggacacctctgcctgcagttccacctgaccagggctttctgaaccctcttccagcctggctgccatctccagccctctatggcctcaccattgaccactcctgcatccggtggaactcgctgtgcttggggaggcgaggggcctgcgcctactatgacaacgatgctctccgagacaggtgagggcccatcatgtatgtgtgtcccagagccaggccctgggcttgagatgacagtagtcatatgcccagtggctactgtgggggctgtcaggcttccaaggaagagaacatgaagggccacctctgcggccctgccatggacagggagcaggggctactataacaggcatttcagggctcacagggagatgtccagggacttccatgacccgaaagcccttggaaggggcagcagacccagggacttccctgacccgaaagcctttggaaggggcagcagcagaaagaaggggcggggatggctggagcccaaggaagaggccatggctgtggaaaaattgggggcagcctcctgctgctcagagacagaggggggccacatcatggctcctggcagaggtccagggcagggggaccaacctgcctcaatgggccaagtccagctgcagtgctattgggttctgcaccccttccagccacctcacctgctgccgttgtcatatggcccagaaaccacaggaaggtgggcttgaggggactgggcaggggctggaaatggtatgggagtggcagagaagaccacaaaagggacaggccaagagggcagtgagaagatgcctctctccttctggctctgcttggaggtcaggaccgtctgggggtggctggggcagctgggtcacctctggccctctggaaagagccagtggagggatgatgagccctggattaagagtcccatgcctactccctgcctgcttccctacagctttgttcccttttgggtcaaagaaatgaggaaagtgatcctcacctggatggtgcccacaccttccgcgggccagcgtgggaatgatgtggttcttcccagtggtcctggccctgggatgtgggctgcagagccccctccctcaccagtcctgcctcctcctgcccacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatatttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaggtaacttggtcatgaatttatgttgtcatatacatctgtcagagaacagacagcacctgcactttttaattttattttatttttatttgtattttatttttgagatggagtcttgctctgtcacccaggctggagtgcagtggcacaatcttggctcactgcaacctctgcctccttggttcaagcgattctcctgcctcagcctccagagtaactgggattacaggcctgcgccaccacacctggctaatttttgtacttttagtagagacagggtttcaccatgttggccaggctggtctcaaactcctgacctcaagtgatcctcccgcctcagcctcccaaagtgttgggattacaggcatgagccactgcgccctgccggcacctgcatcttgtaaacagaggaagtgctcatgacatagaccccaggggcccatggccatggagattagaggtaatgcaactgtcaacccattagcctggtatcaggcaagtaccagacactgcttattccttcagtgaagttctgctgggctctgagaaggccgcatcactgctcttgggtttatatccagaagcggagctggacgcaaacagctatgtccatggcacaaaacagaattaatatcataatcaaattgatcacatggtcacaaccagtactactactcccaagaaaatctttcttttcagctgtcagcagggaatataatagtgtcactttcatttcacttctagagcaaagcttaacaaactttcttgagtgtgtgacactcacagaggatgcaaattcccaacaccctccacccagccccagcgtctacttctgtgggtctaatggggacccaggaatggctcttttaacggccccctcatgagattgatgtgggtagttcccaaatcctgtgaggtgggctgtcagtgcaatagagcctggggtatgcccatttgtgcttaggccactgagaaatttacaggctcgataggcctttggtatgttcaaaggtgagtgaaggataacaaggtgaagagatgcctgtgaatctgattttttggatggctgcaactaagagtcaatgggcatgaaaaacaatccaagagctcacatttatatgaggcccttatcagtactgagagagacattctcacttcacaagcttggatgtgcaaaaagaaaaaaatcacttatttctttaaatcagttattgatttcaaaccccccatcctactgtctggctggaaattcaatatcaaccatgcttgggtctggctcctagagccatctgaaggtccttggatgcctacgcattcaagggtgccattgtgggtctttggtccctttcccatttgaggctgtttaatggccctgcttctcacctgagcctggaaaccctacaaagccgagaccccagggttaggcccacctccctgtgcacactcgcggctatgccctctcccggccccagtcctaggaagcccactcctctgcaccactccctctccctacagaatcccgctcctcaagggctgaacaaaaaagccggaaaaggaagagtgtgcaggaaccttttttattcaatccttcttttacccttcttggaaaaagcgcaaatacagtgataactaaataccgtatctctatcaattatcctttggcccaaagccctttggggtgatcctccatgatggatgccccatgtaaaggtgaggaatctgatcccgaggaagcaaccattgtggccaatttcacatagataatagctggccaggtctagactcaaaccaggctgtccacttctctctggtccagcccaattgccccagctgagtcattctgaagagtcagcatggactaaaatggtggggaggcccctcttttcccactgatgttcactggcccatgggagggaagtgggggaatctcttgagggccattaaggtgggtaacaaaggcaaaagaaccaggtaacagttcatttacttaccttctattcaactagc

SEQ ID NO: 14491 - DNA, 44249 bp, Human
acatagagacagtgtttctgtatgagcatgtgtttgctttgtttgtttgtttgtttttattggcgtagttaattaaagatcatatacccaggaaggtggtatggaaggagcagccagatctaattttctttatacccttcaccgtgcctagcatagtgcataggtgcattcaatgaatatttgagtaaatgaatgtaagaaatatacagaccattggctgagtgtggtggctcacacctgtaatcccagaactttaagaggccaaggcgggtgcatcacttgaggtcaggaatttgagacaagcctggccaacatggtgaaaccctgtctctaccaaaaatacaaaaaattagccaggcgtggtggcgggtgcctgtaatcccaactactcgggaggctgaggcaggagaatcgcttgaacctgggaggcagaggttgcagtgagcagagattgcgccactgcactccagcctgggcgacagagtgagacttcatctcaaaaaatatacatatatatatacagagagaggccattaaagcaggcttttaagccagaaattactgtcttcccaatgattaataagtatttttaaggcttcattagtgacaaatatgttacatgtataaacagatgggcaggacttaaaagagtaggccagatagttgatactatatctaaacttttctgggtgcctcttagcaaataaatggatctctctctgttccttgttttacttcccctttccccgaggaaaatcacatttttcaggtctgacaacaattttcaacctgataacaattgctccggtttcattttggcaactgctaaaatggtcaccttgggaaccccaggcacacacgctgactgtacttgcacagcttctacactgagccttttggaaattgcctccaggaagcctgtctctcatctcacaaacagaaccactgatccaacctgggccaccatctttctgcatctgctctgtctgagactctcccagtcagctcctaaggagacagggaatcctgcatcactcatcgcttaggctagactgaaggtctccttccaaaggcaactacttactactctctgccttgggtcatacaataagcactactcttatctattcacacgctaagctacttttttaaagccagctttgctagctagccacctcgaaattccccagaaggaatcaaacagaaatggaacaaaggacaggaaaagccaaggaggtttgctgaaattgaagcattctgaagacagctgggtggtaaaatggatgtgacgtgaggaaggtggtcttgggtgcacccacagaccaacactgccattgttacaatttgtgtaggatgatctcaggtgacagacagcagcaatttatcacacccagaaacgcatcccccacacatatttacttgagggtaccagacctgctcacaaagcagagaagagctaaggcggttctctaagggcagagaattgctgctattgcctagtgagtggggagagggtactcctcaggccttacttcctatcaaatcatgtgtcagtgttgcctaggagacagaggcacagtaactactgtagccaaacaaggcacataaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgctctgccgctgcttctcatcgcatggccaccgcatttctcagtaagtgggaatcaaatgcttcactcaccacagagtaagcaaataaatatcttttttctatgacatgggctgtaacaataccctgtgctccacctcctaataatttcactacacccagggtggggaggagggttaggaaaagcaagaaacaatgacttctaaatatatgacaaacttgtaaacaacaaaaaggggaaacaaaactccttataattctattattattagcagggacagaactaataatggtcccattaaacttgcatcattaggcaggtcatgttgattctgggtataaccttctattcttgtgttttggctcagtaagtgagatgtgcaaatccgtggcaaggtgagtcatatgaaaacaacacctatggttttgttagtgcttacatcaatataagacatctgttttccaccgctccagataattatgcaattaaaatgagaacatatattctgccaagatttcttagaaaataaatgagcttccaaaatagggtatagggtttaataaaatatctcaggaagtttcagagttaagcaagaaatctacaaataaagaaacaacaacaaaaagtagagagaggcactttatctaactgaaggaggcgttctgctttttctttctggtaggggttcttggatttccaagattgtttcattgtatataaaatgtacccaaatttgctgaaatatgtcacttggttttgtgttcactaatgtatttacctaaagcaaggtaagcatatttccatgtagacagaaaaaaggatgaaatggaaccaaaaaaaagggggaaaaaggagagacagagcgagaatattttaatacccttgagcctaaaattaataaacacatgaaaagtgatggtgcttttatagccatgtgaataatgtacttagtacttgctttaatgaattaccatactgaacattttattacctggcatgatttctattttaagtgaatatgtcctctttcatggttatcgaaaaaggaatttatgtagctatttgttagaagtttgcatttcaaagcaaaataaagttttagaagttaaatcacctcatttgtttatattatttgaaacactgcatgggaaacttttaggcaaaataccaaaagtgggccaggcttgttacacactccccagcctgctgctctcctgacctaactcattcctctgttaggtttcaccgcacattgcacattagggctgtgcactaatttgcttctattccacacagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggtacgcccaggagcatggatgtgagatgacaaattgcaccatgtgcaattggcaggaaatattttgctactgggatatttgtagcaaactctttcttctatttttccaaatactcaaggtggcaacaccatttccacttggactgacagagagttttatgtttacagccacaacctgaactcatgagttctattttaggactatttcagaaatttaatcaaaagtacagtagtagtaaaaaaaaattgcatgcatgataagtggtccttattattcatttatatatttaggaatgtgcagtttttcattggggggtaatgcaatatacctaggtaaacatgtcttttgcagtttataccttggtttattcttcatcccccaagagataacttttattgctgattatactgtacaggataaaagagaaagtaaactcttcatatttaaaagcctaccagagcatgaatcctctcagttgctttacaatttctgccactaaggttgagtctggaattaggtgttaccacagttgactcaaaaaggttttaaaaacaggggtgccagtataactttggttataaaacgaacgccccaggcagaaaaataagttgggaaaaaaaagaggggaaaatatttgtaagtctgaacttcagtagaatttgaccagttctcaagaacgctggggaaatccactgctaattgtcaaaattttaccaaacttcctagaaacacctatagggaaggagactgtggttgttttctccaaaatttcaaaaaatgtaacacctatcagaaactagatttttagagagcacttgaggaattttagattgactcaatgaaatgttatatgagcaagtagatcatgagatcatgatttctcttaaagattgagcatgtcttcctggtgatagataaacaacctatagttgcttcattctgcttagtttgcatcttattttaacaatttaatggttttctgctagattttaattggtagccatgagaagaatgagtcgaacatattgtcgatatatatgtttaagctaatgaagtcgctctattcttttatagtgaaatatgacccagttgacatctacataacagtgtatctttggattaaagaaatggcctgaagagatttgttgttgttgttgttgttgttgttgttttaagcagggacaagaagtattaaggggccacagagagtgagcagaattgtagaaaacatggtatcaaatcctgaagctctagtactattcaaccttatgtaaaatttatctgactcacaaaaaaaaaaaaaatgtcattctttttaatatttagacccctactgagtaccttgtgctgcctataggacaactgattttgttcaaaagcacctctttttaaatatgacaatgagacatgaaaaagctgtctatttatttatggccaaaaactaataatcaaaaattttttgaatgattaaatttgaaaaacaattctatttttagcagctataaaatcagaatacatgacaaattctaggggagagtgcttgctcatataaaatattcaattatctctccactgagatattcaacagttttatcatttacttcaacaatttaattgcaaaggataaatacatgtttattgcttttacaagtacatttataacatagttttactttgccagtcagtgaaagtcacaaagaaatattaattttgcagttttttctgacctagaattcctattattgaaaattagtgcaaaatcagagcatatttaatattgtttcaggaaatgctgacattttaagaaatcaccttcataacttaaagaggaagctatctttgttgctgttcttaaggaatttttatctttgcttctcaggcttagtagattactagtgttttcccttaattcattaaaattctcacttgttgaaaattttaaaaaaattatagagtacctgcttttgttgtcatcgtcatcgtttcattttttttttaatttctacatggtgtgaaatcctcagagaaaaataaacaggattttaaaatcaaaactggcatacttctgattaacagtacttaagcttatttgacaaggaattgagtgatttatatgccgatcctttcctgctgttttggcattttaccaatttcattagtaagttcagcagtaattgtagcaacttaagtaataatttaagaagtaataatgaagttaagagtgttctgtgctatttcctggaggtattcatttagcccaggtctctcctgtggttctactggaattatatttggaaaataccaagccacttaaataaatgttttaaatgaaattataaatcattgtaattagtaccataaagttgacagagcataggttttgccattggaagatcagagattgggtctaggctccattacttaacagctgtttgatctttggcagattatttcagctttcagactcctttccttcatgggtaggaataacgtccatggaagggatttccatcatgtataacagccacatgtgtctggtaccaaatctctggggggagcacgtggtaagagagtaggaagaactcctttgtaaaagtgaggacaacacagggggaagccatgcgtgttatttgcccttgaaagttaagttcttatgaaatatgcctttcaaaatgtgcagaagaaaaactcaagacttctcatctacagttcccagaaagagatcaccgactctcctctttgacatgtagaacaggatgccgagacttttgtgtgtgttcacactgggttatcacatttccagctctagattccttctcattgcccaattgtttcaaggacatagaaatactgtctttattttccccaggtctatcactgtgtttttcaattcttttgtgatccgctccctttgcggggtgggggggggaacaaaacaaatcaacaaacaaacaaaaaaaacactcttcaaagtaccacaagttgattctggattggtgatacaaagtttctcttaggctacagattgttttagattgaagtttcctgtcatgttcactcatctttaaatcctcatagtgaaaaaggtaatgttgtttatttcttttgctgactatgctagaaattctgctattcaaagatctgctctggtttcttgtcgaaaagcaatcccttcctatttgtttccttctcttccagctttgcacataccttgggttccaccaggcatgtctcttccctgttgtgtgcgtcaaggactctagttcaccctttagatggcaaatcagaagtctctgctcctattgtaccccatacacacctttactgaggcagtttttcaactggtttacatttatcaatttatatttcattctgtccttcaaactatgaatctacattggaagggcaaagtccaacatttggtcatgtttgtactttttgcgcataacaaatatgccataaatgtctgttaaatggccaaacgactgcattttatgttagaaagcagctatcagtttttcttaaaaatagcaacaagatgattttggtatctcccttgttttctgtaggatatgatcatcgtggcgcatgtattactcatccttttgggggccactgagatactgcaagctgacttacttcctgatgaaaagagtaaggaccttctattcaattcaataatgtttatttttaaaaatatgttagtaaaaggataacattatttcctcttaaactgtcgattagaacattatatatggatttttatgagacaatatttatccccatcagaagacagatgctttaaacatgccatattttaagaaagcaatgttggctgaaatgcaaatgttatgctacagtgggaaatcaaagtcaaagtgtgggtgtccgggcaccatggaataaagctggcgccagtggtcgcatttggaatgtcttctcacacaagggagtagttagaaggccccatgaccaaacgttaagaaacttccactgcattttgtcctgaaatctgctgatgttatgtatttgatgtgatgacagagtttaaggaaaatcatcacatggtcccagtctagcattgtcaacagaactatctatggtaatgacaatgttgtatctctctaatgtccaatgcagtagccactagccatatgtgactattgcgcccttgaaatatggatagtgcaactaaggtaatgaatttaaattaatttaggccgtatgcagtggctcacacctgtaatcccagcactttgggaggccggggcaggtggatcacttgaagtcagaagtttgagacccacctggctaacatggtgaaaccccaactctactaaaaattcaaaaatagccaggtgtggtggcacatgcctgtaatctcagctacttgggaagttgaagcaggagaatagcttgagctgagaggcagaggttgcaataagctgagatcgcacaacactgccctccagcctgggcaacagagtgagactctgtctcaaaaattaattgattaattaaataaaatttcaatagccacaagttgccagtggctaccgtaatggacaatgcaatatagacagagctctaaaagtcctcatgtggtaaacatggatgtagaggtgtggaagtccgttaaggtcaatggataaatcctgataacttagtaaatgaataaaagaaggttttgtagttgtgtgtacaataccgtcctaattgtggtaaaaaaaattaaaaattgcataaatatacgcccagaaaaaacataacgaatatatcatatgttaattccattcttagtggtacaattattttaaaaaatttattttcttctttttgcttatctgtgttttccaaaatttcttcaataaacagatattgattttgtaattaaacaaaagctttaattttgaaagcaaagtcagagaatggctcatgcagggggaagaaaccttttctttctgtaaagccctatttaagtaagtttgcttgcaaatatttttgtctgtgactcataataagaggtaaatacatttttacattatgtaccagcacacatacaaatatataactacctttatgtagtggaaacgagattcatgaaacagctcttattatgtttgatgcacactgatattttctattctatttttcttccacattactaaaacaaaaattctggtcacaaaccaatacattgttattattgcctgttaatggataatgactctcagtttgaaaattatggttatagtgaatagtgatatagtaacatgttcatatttcaataaaaatataggtattataggtaaacacctggacatgggcaacgtaaaaaagatattaaaaacagttttgaagaaacctcttctaggacaggcgtggtggctcatgcctgtaatcctagcactttgggaggctgaggcggacagatcatttgaagttaggagttcaagaccagcctagccaacatggtgaaaccctgtctctattaaaaataccaaaaaacccacattagcccagcatggtggcatgcgcctgtagtcccagctactcgggtagaaatagccactttctctttgccccggtgttacaggcacgcaggagcaactgtgtctgtggtgctggcaggtccaggacagcatctgcagggcaataaatattcgaaaagttttaaaagtgctgcctatgtccagttgaacattgtgttgtttctttatcctttgaatcaacagtttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgacgtaagtgtttattctaatggatatccttattgagaataaatatgcattttgactgcattttctttatcaaataaaattttggattaaaaaaataaaattactgacaggctctttgttatgttaccagtagaatagtgtctctctaagaatgcctgtgagctagcgccgggtgtattgttcagcgttaaacagcatcacagaatattttaacttttggatgattctttcccttaaggaagaatgtttagtaactttttaggcaccatggattgggtactggttttctgtttcccataaaattaccaacagaacaggagacagtagcctagtaaaacaagaagtgagcaggcagagtggagagtcagggaaactaagttcaaaacccagttcttccacttcctgcctttgcaacctgggacaagtcatttagcttctcagagcctcagttttacctcggggctacattcaggcacctgctacatattaggtgtgcaataaagtcaaacaaagggagaagtgattcatattcactatttttcagtcaatatggaattctagagaattttctgtccgacattgacctctggggagatggtgctcaaagggaacttgagtttaactgtaatatttcgcttgtatttacaagaataatgcgttcatgtgtcattgagaaattactatgttgttattacaatggttttgttttgactttttttctagcaaaactatttcattgcatcttactaatcatttaaaaagtagaagaaaatgcatatttgattaaaatagctctcttaagtctagttctcttttatgtatcatgacttgtgggttttatttttagtatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccaggtaaagcaggcctccaaaagtccagtttgtatgttttggactttgcaaatatggaaaagtagaaaaattaacactaacccacttttctttagtcagtcacccgttcttgtcaagtactctcccatatcaacaacatcctaaccaaggctgctgccacttcttatcataaccaactgaattccatctggcacattcttgcagaaatatccacagtctctgcattggcctccagtggaaagttggtgtttctgatacttagagtcagtaatacttctgatcaaacacttaagtgcacacacaacaggggagagaaaagaggagaagcaggctaccaagtcctgggacatgtgggtgcacccaataaccattgtcttggtcagttgagctcacgggtaattttcaaacgactattttgtcatatcaccagctgaagagaccatacctcctgaattgtgtcagtgacttaaaacagaagcataaagatcttctcatttactttttttttttttgagatagaatctccttctgttgcccaggctgaagtgcagtggtgtgttcttgactcactgcaacctctgcctcctgggttcaagcggttctcatgtcacagcctcccgagtagctgggattataggcatgcgcctccatgctggactaatttttgtattattattattattattattattattattattattattattgagatggggttttgccatgttggccaggctggtctcgatctcctggcctccagccatccacccgcctcggcctcccaaagtgctggggttacagacatgagccaccgtgtccggccccatttacttgttataacttgtctagaccacataccagccaatttgcatgggcttgatcccaagtacagagactaatccaaggtagatacaggaacacagagatgggttattgtatgtggcttacgtcaaaccaccattcctcctttctataatgaacaactggattttacctatgaggcactttgcagcttacatttctacaattctaattatcctctgaacactctgatacaggatgacactaataaaaattatttctgttttgaaccaagtggaattcacttaaatgattctttggatgagaactataagacaaagagttgtcaggatctctaaagtgtacttgggtgtggactttctggtcatttaatgcatggacaaatatatattaggttggtgcaaaagtaatgaccaaaatcacaattacttttacatcaacctaatatatgcatatatacatgaactgaataagtcaatttgctttgaggtagttcttctttttgtctgtgcaaaagcacagatatgaagaagaaatccatctttaacttctctacaggtaataagaggctctctctcatcatcttctccctctgcttcttgaaagacactggctgacagtgataaaaatgatctacagctcacttaagctacgatcaaaagacccccttctatctctcaaggctcccacttgaatgcggtccttcctggcccaggtgcaagagcttgtttccttctctgagcaaccaccaacaaggccagtgtttcccacagtgtattttaaagaccaacagttaatacagcaacgagaggttgaaatgaaaacaagcctttctagtcacataatttgagaaatccttaatgaagcaaacataaaaaggttgcatttaaaatcttggccgggtgcggtcgctcacgcctgtaatcccagcactttgggaggccgaggcgggtagatcacttgaggttaagtgttcgagaccagcctggccaacatggtgaaaccccgtctctactaaatatacaaaaattagctgagtgtggtggcacgtgcctgtaatcccagttactcgggaggctgaggcaggagaactgcttgaacccgggagggtgaggttgcagtgagctgagatcatgccactgcactctagcctgggtgacagaatgactctgtttccaaataataataataataataataataataataataaataaaataaaatctgaaggttttgttttttgagacagggtctcactctgttgcccaggctggagtgtagtggtatgatcttggttcattgcagcctcgacctccccagctcaagtgatcctcccacctcaacctcccgagtagctggaactataggcacatgccgccacacctggctaatttttgtattttttgtagagttggggttttgccatgttgcccagtcttgtttcaaactcctgagctcaaacaatctgcccgcctcagcctcccaaagtgctgggactacaggtgcatgccaccacacctaatttttatattttttgcaaagacgaggtttcaccatgttgcctgggctggtctcaaactcctgggctcaagagatatccacccgccttggcctcccagagcactgggattacaggcatgagcaccgtgcctggccaattcaaggttttcttcaagtcctagtatattaaagaggactttaacatgctaatgtgcatcaagtctgcaaagtctgcaatcttgcagtgttgtcaaaactcatttcttctgagcagcaacctatgtaattcatgaagaatttggatacaacctaatgaatcacacaattctaggatggaaagggatacgcaagaccttcctgtaccaacccgctcctttacagttgaaaacacagagcccagaagagtgggggtcaatgtctcacagctagttattaacaaatgtggcattagagcaccaaagttgccggacatcaacctcaaaatgacaatatattgtacttctcttgaacttccacacatgtattgcacaaacaccacccccaggccccaaacaaaatagctgggaagctctcgaatatcagaaatggggactttataattctaattccatatctccagtaagttggccttttgtagttagtaggtttctagaaatatgtgatcatggccgggcatggtggctcatgcctgtaattccagcactttaggaggctgtgggtggatcacttgaggtcaggagttcaagaccagcctggccatcatggtgaaacgccagctctactgaaaatacaaaaattagccaggtgtggtggtacacacctgtcatctcagctacttgggaggctgaggcacgagaatcgctccaagccaggaggcagaggttgcagtgagccaagatcgcaacactgcactgcagcctgggtgacagagtgaggctctgtctcaagggaaaaaaaaatgtgaagatgattattttttggtgatgaatacgacgttcacatcactatagttccaaaagaagcatgaaattcagagtttgccatggcaatgttttgtcctttttacttttgactacctagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggttagtactgtacctatttttacttaggcaaatggttgtttcctgcaacctcataacactcgtaaatgttccaatttaggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattggtaagaccgacttaacccaaagctgaaataactgaatctcggaatctcagcactggaaggaagggttataaagatcacctagttttactgcttctctgatgccaagtaagcatcagacccatgtttgaaaaccactggggcaaggttctccattccaacaccaccagtgatttttgctggacaactctgtgttatggagggctgtgctgggcactgtaggatatttagcggcatctctggcctctacacactagatgccagtagtatgcccctctgtccttgagctgtgacttttaaaaaagtctcagactttgccaaatgcccctcaaggggtaaaatttcccccagttgagaatcactgcaccagaaaaagtgaatttagctgcttaaaagagaccatttaatccttcatgagttctgacaggttttgtgaaatttctgcccctgggtcctgtgatggactagtgccaccccaggtgatttgagtcccttccctgtagaatagcctctcttagctgttcacaggcagcacgtttcccatccagaagcccttcttctcccaggctaacatctctctctctctgaatttctcactgttctggcccatctcctggatgttctgcagctcgaatatctctcagtgtgcaattctcagctctaaaaattctattcgtggttttgtctgctcagttctcaatagagaagacactctccctcatcccagatagttctattagtgaaactcatcaggcgctctcacatggcattcttagttatggagattccagatttcaatggtgggtggttattatgggctgtggggccagactgcctggatttggatcctggctccaccactggctgagtgaccttggacaagctgatcattcctttgtgcctaatcttcttatctgaaacaatggagaggaatcaatacttcctgtgcagtcttcgtgagaattgtgttactaatgataaagcacttagaacagtgcctggcataaaggtttaataaatacactacaatattatttagaaggtatgatttggctgtgacatatctatatccaatggaatataactttgtgtaaagaatcatagcccttactaaagaggttatgcaattctctccagtagtatatttcttaggtgaactaaaaatgtcactttcatgaaaataggcaataaaagatgccgaggaagacctaggaaacaatgatattaatatgaaaatggatatgatctagtacagaccacaggaattcatttttcttttatgattttcattttattgaggctgattcctaggattactaaaataaataagtactttcttggttaagaattttcttcatagggtataggaggctctgaagccagtggatcccactcctagcttttccctattaattgtgagatctaagtcatattacctaagacaaggacactcattaagaattcatttcccctcacctcaccggaccataagacaatcaagtgagatctcaagggaaaggacattagagtcctaagtaaagacaaatttagcccaatccactcttcttcttcttcttcttcttctttttttttttttgagacagatttcttgctctgtcacccaggttggagtgcagtggcgcgatctcggctcactgcaagctccgcctgctgggttcacgccattctcctgcctcagcctcctgagtagctgggactacaggcgcccaccaccacgctcagctaattttttgtatttttagtagagagggggtttcaccacgttagccaggatggtttcgatctcctgacctcgtgatccacccgcctcggcctcccaaagtgctgggattacaggcgtgagcccccacgccctgccccaatccattctttttgatgcaaaagaaaactgaagcttcctgctccagcccccaaacaaacaaaaaccaaaagacgcagtaaacaaaatgaaattaaaattaaaaactgaatctcagaaaggggaagtgatttgttcagggccacatacctactgggaagaggcaaggcttggtggaaggtccagggaaatgttctctcagtggtcaggtttattctgggcctggtacaacttgagtagtaaagggggatggtgggtgagtcttgcaatgagctgagggggggaagtaattcaagcattcaactctatttggagtagtaatccttgtagtttccagaaagggtctcttcttcttcagcactataagacaagagtattatgggaggccaccggcttcctgtggcttggagatcagttgattaagacctgatggtaaatatttgaaaaaagcgtatcttagaaatgccttgagaagtgtgggtggattggaattatcagctttgatcactgattctaaaaaaaaaaatcactgatctttcgttccctaacttagatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcaggtaattactcagattattccaatatttgataacagacatttgttttagaaacatttaaaaaattatcttcagtgactgcaaccaagttacagcttggtactaacaaggtcaaagttaacttaatctacccaggtattatagatataaccaaatagatataaaccaaatcttactggccttttgttttgaaagaacatacttttggttgaaactaatacaaaggattagatacagactcattggtactagtgctggttaaaatctaaaatgatagacgggtgcggtgactcacgcctgtaatcctagcactttgggaggccaatgtgggtggatcacctgagaccaggagttcaagaccagcctggccaacatggtgaaaccccatctctactaaaaatacaaaaatcagccaacgtgatggcgcgtgactataatcccagctactcgggggcaggggctgaggcaggagaatcacttcaaccagggaggcggaggttgcagtaagctgagatggcgccactgcactccagcctgggtgacagagcaacatttcatctaaaaaaacaaaaacaaaaaaacaaaaaactaaaataatgcagctactataaaaacgatatgatgaattctcaaaaaattagaaatagaattcccatacgatccaacaattccactgctgattacatatacaaaagaatcgaaagcaaggattcaaagagatgtttgtacacccatgtccatagcagcattattcacaatagccaaaagctggaagcaacccaagtgcccattaaatgaatggataagcaaaatgcagcatatacatataataggatattatccagcattaaaaggaaggagattctgacacatgctaccacatggaggagccttgaggacattatgctaagcaaaataagtcagtcacgaaaggacaaatactgtctgattctacttttatgaggttaaatagtcaaactcatagaaacagggtaggatggtggttaccaggaattggtaggagggtggaaggagaggtattgtttaatgggtacagagttccagttttgcaagattaaaagagtgttgaacattggtgacacaacaatgtgaaactatttaatatcacaaagctgtacacttaaaaaggattaagatggtaaatttcattatatgtattttacaattaaaaaaactcattagcactaatagacaaaaatttcaaggggaaaggaactgagaagaaagccaatcaacatttcttgagcatcaattatgtgtcaagctttattatgtgtttattccatcctcacataattctatgatgtaattaccattcccattttataggaaagtgaggcaaaagagatgaagtaactctcccacagtcacaaagctaggaaaaaaaataggattccaacttatgtcttacagagagtagacaaagccaattcaattagattcaacaaatatttacaaattggcttctttgtgagaaataagactgtttctgccatggagtgacccaatcttgtgacatacttgcccagccttggggttgccctcccacaggaaaagccagtacagctagagatgggggtgtgggcacagagcctgctctgcagagaggaattgaacggaatctgtaaggatgaagagaaactagtctggtgagaaaacatgagaaggactttcttagccagagcttcccaaaatacttacactgaaggactgtgtgtgcacgtgtgtgtgcgtgtgtttttataatgtctaatctaccatagattggtgcttttgtcaaatacaataaaaatgatctgctagaaaaaattaaatatagccaaagacatgtaaagtgtcagttcactgatcatgtgtttggatatcatggcaatgtcaaattgctatcaaaacttccaaattgcagtcataattttatctgtatttagcccatcacaagccagtaataaatagttcctgacttgcaccagcctaggaaaaggagtaactttatgcttgagagagtatggttctttcagtcaagtggcaagtaattcagtctgcctggatgcctggacataagaccaatgctgaaatcatgactctgtatctgacattgtgatttctcccagagtggctctataagattttgctaaaaaataaagaagtggcttcttttttaaaaaccatgactctgggcaatggatgccactgaagagttttacacaatagagaaatatgtctacatttgcagagtaaaagaagatttttggtagcagcatgaaaactggatgtgagtggggaggggcgacatggacatatgatatcagttagcggctactgcaaaggtccaagcaaaagataataagagctaaaataggcaatggtcacagggctggagtaaaaaagggagaaacacctccgggggtattcaagatacaggtgtcaggagcacatctctggtacaggggactagctggatggtggcgaccatgatcagtagaaggaaaaagaagaagggctcattcatgagaaaatagcttcatttcaacactagacaatctagcgttcatgtgacattatttagtaatgtgactatagattatggagagacaaggtgagggaataatgcattctagcataggccactccagtctttcagtctggaaacatcagctgggcctggataggaacacctggatcttgaccgttgatcatttcgtatattttggttacaagatagcgttccactgaagggtgactgccaacacatccacactaacgcacctagcataaacgaattaatgtgtgccctgttgattttaaaggacttgctgaacagtgagtcacatgacctatataggacctcccattctgataatcggcagaactaaattaggtgtctagagattcttctaatgctatctttccccacttagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttctgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgttggtaatccagatcttactgatttcatcaattttatatgtcctcatttgtttgtttgtttttttgtttctttttggacagagtcttgctctgtcgccctggctggagtgcagtggcgccatctcagcttactgcaacctctgcctcctgggttcgagcgattctcctgtctcagcctcccgtgtagctgggactgcaggcacatgccaccacgcctggctaatttttgtatttttagtagagacagggtttcaccacgttggtcaggctggtctcgaactcctgacttcaggtgatccaccggcctcagcctcccaaagtgctgggattacaggcatgagccgctgtgccgagccatatgtcctcatttgtatgtgtctgtttggttctatgcaattttagcacatgtttaagttcatgtacccatcaccacagtcaagatacagagcagttgcatcatcacttgttacacttttataaatacacccatctctctctcctctcttctatccctgaactctggcaacgagtagtctgttctccatctcttcgattttcccatacctaattttgactttatacttttttaaaaaaagaagattccaaaactgtgtaatctatagggtcccacaaaatctggatctgtccctgagccttcagcctagcagatatagagtataaagaggtccatgcatcaccgggactcctgtgttagctctgcaactgtttatgttacgatcaaatggactagtttgcttggcaagtaagatgggcatcgtctctgtcagtgagatccatgaaggataataatatacccaatggcagctatggatgaaggggcacatttccagtcttaccctgacacagatgtcaattccacacccaggacatgtggtattgcaccttgaagatagaaaattcataccctgtgttggccgggcgtggtggctcactcctgtaatcccagcactttgggaggccgagatgggcagatcacgaggtcaggagatcgagaccatcctcggtaacatggtgaaaccctgtctctactaaaaaatacaacaacaaaaaattagccgggcgtggtggcgggcgcctgtagtcccagctactcgggaggctgaggcaggagaatggcgtgaacccgggaggcggagcttgcagtgagccgagatcgcaccactgcactccagcccgggcaatagagtgagactccatctcaaaaaaaaaaaaaagaaagaaaagaaaaaaaaaaaaaagaaaattcaaaccctgtgtttgctattatccaggtgtttccggcaagtcaacataggcattgtatgagagaaggaaacagttaaaaagcaactagtgcgtctcatgtgtatgataaaccattcagcctggggaggcacacacacgtcgttaactgttgcactaggtctataagagcatgggatggtgggaagaagactggagccttacatagaaagcccaggtttaacattcagcctttacaaggattgattgtgtatccccagacaaataatttctctctgtttcctagggttctcaagataaaggagataacatccagctttcctgccccacaccgtatctgaaataaaaacaacagcagggatagcagattacatgtgttttttaatttttatttattttgccaagcactatgctaaatacataatcttagtcctatcaaaaaacttgtttggaaagtttaggtaattggcttaactctgttctgcatggccaacaagtggcagggatggggctctaaccccagattaactgactctagcacttgatctctggacactctggcatggtgggacaggattctgcaagctttaaagtgctgggtagattaaagtcttatttaagagatcttggggatgggtgcggtggctcacaccagtaatcccagcactttgggaggccgaggtgggcagatcaggagatcgacaccatcctggctaacatggtgaaacttgtctctactaaaaatacaaaaaattagctgggcgtggtggtgcgcgcctgtagtcccagctactcgggaggcaggagaatcacttgaacccaggaggcagaggttgcagtgagccaagattgcgccactgtactccagcctgggcgacatctcaaaaaaaaaaaaagacatcttggtagccaacctttgtgattatgggtgatcaagcatgtggatgccatctctcatgaatcctatgaggtattcatcaaccattggaagagtatacataggagagatttagttcaggcacatgccaaaatgttctactatttaattcattcgcttaagctatggggtaggtcttcaggaaagtctcgggcagtgacccatcagcccatgtgaaaatgactccgatctgacacacagcaggtagatttccactgaagactgggaaagataaggaaaggcctaataaatggagaactgttctgaatctgccagggggctggtcgtgctaagttaccgagttcccaagggagaatagcgtcccctaaagttgtgcaacacacaaccagctcagccttacaggggtagccctcacatcactcagagagacttacaggagcagcatgagccttcctggggagagggaactgaaaggacactaaaaggaagtgagaatgggctaaactcacctgcttcataattctgttgagaccaatcttcccctccctcccctcctccctaggttgatgcccccacctaactaaactgacccagcacacacaggactttcctcgacatggctccatttgcaccaggaaaattcactctgttccccaggagggaaacaaatacgagaagcattaatcagtctcagggaatttttaacaaggtcattaattttgtcaaatgcctaaggtggaagtttaatttttgttacttgaattcaatagacttctttttaaaaatgctttatgttactccccaggggcacaaaactcactggctcaaaactattgctatttctaagtgtcttcccaacacctctctctatatgtattcaattttggagattttaaaatgctgtctaaggaaacttaaaccaagatgatggataccaaggtcagaatcctagataagaagttagttatgctttctgagtctttgacttttgaagtcatagtcaatgttgactgtagagaatttagaacgtattaggtgaaaaagaagcactagatattcaggacatctaggtttttagctacggctctgccaacatctagctctatgatataagctagagatgacaaaaggtaatgttttgtgagcaaagtaatcagagactgcttagagtgcagcattgaggattctgaggctaaatttagattgtcagaaggaatcgtgatctcctgccaccactgcaagggacagagtggtgacgagcatgacagggtttttccaccctggcctagtcagtctacacctaacctctctgggcttagcatcctcacctgtaaaatataagtgctgcactacaaacctgcttccacctctgccattcacattcacctcctctgcaccaccccactgcaaaagtgctgagagtgaaattgtgatccataacgagcgcttattttaagcttgtttttaatttattattcactctccactttagagctctcttaccattattatttcctaaataacaccttcctagtttgaatctgggctcattatagttttcccccaggtgtacctcgttgccattatctatagcaaatcccatttcatttactgccatccttttcatgaagatgagctgattaatattactactcaccttataaatccatcctttctggaatttactcctctgctcagtttaggatcattagtgaatttaatcaatgtagactttccattttcatcaagatgattaataaacgtaataggaagtccaagcccctctgggacattttgcatggctcttttttatcccttgaggatgcagcaataattatactcagctaggagtccatcaggcgattttgctgctacattcatttcctttaactatgctttctcctcttttgccttatcttaaaaacagcatgctgcagccctcccactccattttactccaagactcaactcaaatatcacccctttcatagttattaatttcccccccccattattttaatgtaagaaaatggaggtcctgagatactaaatgactcagcagttgtcaaacagccaagaagtggctattaatatacaattttctcaaatagatgacatatgagccaatcagtgaattagaatagatttgattaactaattaacccattatagcccaaggttatttaatttaaaaaatgagacacagagtaagttttgattgatgagataaggtgagctgggagaggctgggggtgctgtccagctctgttggtaaggtccctggccagccaaggagcacaggggacagcagggagggggtatagttagcaagtgagtgctctttgcttgctctgaacagtgcctgattggctctcctgtcctagaatttccagagcatggaattttttaaattaaaaacaattgttttatttcagcagctttaggggtacaagtggtttttggttacatggatgaattgcatagtggttaagtctgggcttttattgtacccatcagctaaatagtttacatcatactgaataggtgacttttcatcccccatgctcctcccaccctctccccttctgcgtcttcaatgttcattataccactctgtatgcctctgtgtacccaaagcttagctcccatttataagtgagaacatatggtatttggttttttgttcctgattactttccttagggtaatggcctccaattccatccaagttgctgcaaaagacattattgcattctttttgtacagctgagtagtatttcattgtgtatgtttaccacattttctttatccactcatcggttgataggtacttaggtggattccatatctttgcaattgtgaatggtgctgtgataaacatgcacgttaggtgtctttttgatatagtgacttctcctttggaagatttctcaaaaaactaaatgaggcctacaatttgattcagaatttttttttaagagatgaggggtctcactatgttgcccaggctggtctcgaactcctgggctcaggcaatcctcctgccttagcctcctgagtagctgggactatagctgggctgggatttttttttttatggaagtagcagtttcattttatcagtactcgttatcaactgccctagatcagctggcttctctgtcttatcttaagagctaacttcccaatttttacatgtctttctcctttttaaactttcttaacttccggattcttctgttcctttgttatctttgctgtctcctgtttatcgaaaccttttgtttcctgaccctggtcttcatgaagctgtgtgttttctcaagtccatcatcttctcttcttcccgccatccttgaagctcaaatgccaagtgtgaaacgaggaatgatgaaaataaatttttccatagtcatatccttgcttgaggaaaagagacttatgtgggtctaccctgcacttatttctggccgtgtctttggtcaggatcagtggttctgagaactgcttcttctgtgacagactacaatcactgcaattgcccttcaaagaaacgatggagttttgctttgacctcactgaaagcaaaatttgatggccaaaatttgactttcgttagtcttgagatgtatggcacctacacccaggggagtagaagactcagcaccgttttcagatcactcattcatgaggtcacagcaattttcagatcactcattcatgaggtcacagcagacaggggcacagcagacagctccttaaacatagagatgtgttgttcataggaaatcttggcctttgctttcctgtcggagtttgagctggtggagtgggggtctcagagtcccgtgacacatcctagaatctgttaggacttaaggaaaatgggttgaggtagggtatcagggtggcctatggcaatatgggctggaaggaaggccaccccagagaaactcctgtgcctttttcttttgacttgatattcatgggctgatgtgtgaggtgacttggtacctttgtcctgggcacctggaatcaaaaactgaagtcacctttgggaccatcaaatgcatcttcattttccagtttgcctgcattgtgccaaggtcccgcagctccaacctgattccttgcactctgactcccacctggagctctaatcccttctctctgtctctcctgatcccgtcactctccttcagcagctttttcttgttaaattctcacactgtggcaaaacacgaaggaagatgaaagggaaatgttgtaggagggtccacatgagctatccctaggccttccaaaataatcttgcaaaactcttttgaggttacagatgggagccactgggtctacacagtagcagaaattgcttaaaagtaacaagagttgacccaataacaacatgaaagacccacttaggcttacctaagactaacacagcttattgtggttctgctttccctgtgtagacagatggcttggtcacactgcttccttttgtccaggctggttagatcccacctggcagccccaccatttgttcccaccagggggggcggactgcctcacgcctgtggtcatcccactagcctgaaggaggcctaacagggacctttcagatttcatctccaaatgccaggagcagggagttcccacagtgctttcaggcgcagccacctctattggtgcctacatcacccttctaggcatacattctgcctcatggagggatggcagcttgtgggagggagggatgctgtcagggggccagcccctgtgcaggacatattcatctacatcatcttttatcatcacacacatgatttcctaatcacacaggtgagaaaacagatgcagagaggtgaaggaactgctggaagctacacagatagtaggtgggacatccgggtttggaacacagctagaggattggctccacacctgggttcttttcgagatgttccattgccccgggggctattactccagccagggaaactgaggctggaggatgggccacactcagcaagaggggctgggggctgtgcaagcaggaagctctgccagctcttgaccctgtcagcctccatccagacaagccattgggaatgaagttagcctcttcaggccattcttgtctaaatgttcctgtccaagttcttcataagattcatcttaatgaacattttgaaccctaaatccttgaagggtaggaatacccatacccttttctgttcctcagtatctagaatatttggtgtgtgtttatttctcctgacctgagtttatctctctgcatttttagaattctgatagcactccaattttggccttgctttgatgaaagggaaattatcttgatgaatttgttgacacaatgcatttcatcctaatcgtaattatagtaagtaatatttattgagcacctgtgtaccagcactgtgctaagcacttcacatgtgttaattcattcgatccttatccctgttttataatgcaggacatagaagctggagaggctaccctgccgaaggtcactttggtagcaagtggcagaaccaggactaaacctttttttttttttttttttatgagatggagtctcactctctcacccaggctggagggcagtcacacaatgatctcagctcactgcaccctccacctcccatgggggttcaagcaattttcctgcctcagccaccggagtagctggaattactcatgccaccccgcctggctaattttgtatctttagtagagacagcattttcaccatgttggccaggctgatcttgaactcgtgacctcaagtgatccacccaccttggcctcccaaagtgctgggattgcaggcctgagccaccacacttggtctaggactaaccctctttatcccttgttgcttacttctatgtgatgactacatcctctgcagccagctttcatctgctttagcaggttgataaaataggcccagcaaccccttatagggaagaaagttctgggttgcttggggggctccagaaggtacatagcccttggtgctttgtgggaaagcctgcagagaagaaaactgccatgaggaattccccactcaacttcatcaagtctagtcctactgggggatattgcagacaagcagtactgcagtgagccatccagctgatcctgaatgcacacacaaatacacgcatgcacacaaatacacacacgtacacaaatacacagtctccatttcctctctctattcggttaatgcaagcccagttccaccagatgaacatagtgcaagctgtgtgtgtgatccgggtccttcactactctacacattttgttcactgaggctgcattttgctgccctctttttatttctctaaaccaggtacctcccacagtccatttgacagctgccttgaaagctcactcacccaaaaggtctgctcctgacttgcctgcactggaagcctgtgatctggtttgggatgttcattcatgaatgatgccattctcccctccaactggaggcaagtcacaggaagctagttaaaccctgtatcatagactgccatattgacatcctctcaattatccaaccctgttggtgccatttgaacttctcccagcacctgctggctctaaaaacacagcaggcctgctctgttggaagcatcccatcaatttactaattagctcttttccctggaaacctattgttgagtctgaaatcagattcaaaatcaatatgtaagcactgaaagttcatacttacatgcagaatttaaggtgtaacaggcttccaaatcaaattcatctcctaagagctagtagtctaaacttcatacatcatagaattctagatcaagagagactgcagccctaaaagggaagtggcttgacaaagctcccagaggcagagctgggactagtttgggtccaatacttgcagtccttctgccctctgtgttgccactgtcccagcccacctgcaccccatgtcccactccatatacattctagggtcatagaagaatagcagactattggcttatttgcaaggtcaaatgcttaagatgtcaaaaataatggaaactgaggtccccagacaccagacaactgaatttcccaaatgctttacgttagtgatgcctaaaaagcacccaggaatcaaatggggagtctggagagcttctcctccttacaagaataggctgtgtgacttcttctttctgaaacccatctttgcataaccaaatggcagtgcccattgatttcttgaaaagaaacatctgtgacttcctttttaatggcaagaaaggtattctccttgagtcagagcagagagtcaaattacctcgaaatactttttttttaatctccaaggttggagaccccagaattcaaattaagactatactacgggatctcccaaattttatagtattgaaattcttaatcattttgacccaaagaatgtatactctcagtgggatcttccctccttgctctactttcagtaaaaccagagcaggtgcttactttaattcactaatgtactggcatttttttttgcataaataagtaactgaacagtagataatccacaagtaatgtctacttcgcaataggtatgtgaaatcttttgcttgcacaaaattttcctgccaatttatgttttcttcaaggaaaagccgaccttggttgtgttttcaggggttagttctgttttcaactagctataggggagtagccctaatgcatttggggcaactggagaggccaggccaggagaaatgactaatgtgccacctccctcccggcagtgaccgtgactttgcttctcacgtagtaccttgtatgcatcaataactttttttcatttaatgaaataaaatcagggttgcctctatatttttgctaattcagtgagaatcttcgcttatcaaagtgagggctgaagtgaataacttgagagtggtttaactgaaaagatttttgtaatcatggtcagaagaaaacggtactgttatcaaaacttgccatatcaggctaggggatattgcacaagttgagacccaaatgtgactgacagtgtgaccctgataattatttacaacactgccccttctttctgcaggacccacactttttctgttggtttaacctagttataaacaggataactttttttctgctgatgtaccacttgctgaatttgcatccggtgtctataaacctgcagtttctgaatgtggttgtcaggatacttgcataatggttacgagcatggaatagtttcagagatggggccatgaagcaggctgaattccttactcaggaaatcgactgggaaataaagtaagacggtatttgatttgctgttattagtttgtcccagctactctttacattaactaagaaagaatgcaataaaaatgaagtctaacagagccctcagttccaatccagagaacggagtattaatcctggaaccatcgaggatctgtaggatttaggaagacaaaagctttgccactttgagggtctgttttccattatttaacaaaatgtggctaatgcctttttgtaaaacaatagacataagtatatttcaaaaaaaaacttgaaaaaaaatactatagccatagggctaggcacagttggtcacgcttgtaatctcagcactttgggaggccaaagtgggagaattgcctgagtttaggagtttgagaccagcctgggcaacatactgaggccccatctctacaaaagattttaaaaattagctaggcatggtgatgcgtgcctgtggtcccagctacttcggaggctaaggcgagaggattgcttgaacccaggagttagaatctgcagggagctatgatcatgccactgcactccagcctgggtgatacagcaagactctatctcatataaataaataaatagtatagccataggtttttaataaagggcttcagtcccacctagagtttggggaatgtcaggagaaacggtagtttgcaaagcagccacctttaattagagaagctgcctgcacacttagccttatcagaaacggggatacaaacaatagaacagggcttcccacagtgaagcacagagagctatagggatcatgctcaggagagttctcaatgaaaagcaatgcttaaaataagtgaagcgaagctcctatgtattcagtgtgccctcagttttgcagagggagggaggggaatgggattcctacatcaaggctaagagcacggactggttgggcttccgcacttcctagctgtgtggcctgggctgacttactctgtccttttctgcctcagttcctccatctgtacagtgagaataatagtgtccatctcaaagcatcgctgtaagaattaaatcgagaaagtacgtgaagcactttacacagtatctgagcacctagaagcactcagaaaaagcgaatgcaaaaatatgtatagaaaataagctcttagttacttccagtgactactgatttttcttttttcttttttatactttataaacttttaaagttccagcagcaaaaaggcactacttttgttttcttttcttttcttttttttcgagacagtgtcttgctgtgtagcccaggctggagtgcagttgcgtgatgggctcactgcagcctctgcctcctaggttcaagggatcctcctgcctcagcctccctagtagctgggatgacagccatgcggcaccacacctggataatttttatatttttagaagagatgggctttcaccatgttggccaggctggtctcatacgcctgacctcaagtgatctgcctgtgggcctcccaaagtgctgggattacaggcatgagctaacacacccggcccaaaaaggcactgcttttctaaaaccaattttattaaaggtatgtgtacatgaagtgacagtaccctcaactgagtgagtggtgctagaaaaggtgctggctggggaaggatctatggattatatatttcaactgccatgtgtttagatgaggaaaccgaggcccagaatgaccaccttcacagcaagctgagactacaagccaggtttccagaataggcagggatgaaagcactggacaaagcctgcctgtccggcactaatcactgggtacgcagtgacgacatgaaccaagggaatgaggagaagggacagcggctgtaaaggatggaaagagtcaaagtgacttcgaggcttcaggtctgggggcttggaagaatggagactgaaatgggcagttagtgagagaaggggtttttatatgaagaagaacatgcgtttggttttgaatgttgtcagccttgagaaacatccgagcaggttttacctacggacagtttaagatccaggcctggagctgagtgtcaggcaggaccaggaataaaaacctgggaaaagacttcataaaattaaaagatgaagtggtataaacaaacttttcaaagttcaaagaataggccacagtggaaaatagcaaagggtcaaaggatgagtggagagggccaatcgaaattaaaatggggagaagggccatctaagaagagatatgggcaataaagctgaggactcggtttcaaggtgggctcaactatacacagtctgaaattcaggaaggaggtcagtaaaaataaagctggaaaaagaaaccaagcgtcttttgaattagactaggaggaagtcactgtgattaaaaaagcagtgttagagatgggaaatgaagcagcccgaatcccttacataatttttttttttttttttgagacggagtctcgctcttgtcacccaggctggagtgcagtggcgggatctcagctcaccacaacctccacttcccaggttcaagcaattgtcctgcctcagcctcctgagtagctgggactacaagcatgagccagcatgccctgctaatttgtatatttttagtagagatggggttttgccatgttggccaggctggtcttgaactcctgacctcaagtgatccacccgcctcagcctcccaaagtgctgggattacaggcgtgagccaccgcacctagcccttattcaagaatttagactgggaaataaagtaagaaggtatttgatgacagtggagagagatggcaaagcagggtcatggcttattcaagatgaaggactctatgaatatttgaaagcagaagggaagagatgaagaaggagattaaaactttcgggaggtagaagataaagcttggataagggtcctcaggaggcaaaaaagcaagagaacaaggcaaggctggaatcactagcattatatcccaaggtatctctccttcctgtcacttgaatgatttgagttttaattattttggaagtcttaggctattaacaaggacctgaaaattccacttatgtatttcttcttttctagaggaagcagttcatggcaaactgagcatggtaaccttttctcctggtgcggtgtggttgaaatctcaccacagtatttagcacgctcgtcattaaatcactgcttgtgttgctatttgctgagtgtgattctttcctaatggactccatgacaggagcacccatatgtgatctttcgaccactgaatcccagtaatttgtacagttccaaacatataataggagcccagtaaatattagttaaatggatgaataaaggaattaatgaatgagcagcctctcccacggaaaggaaactcatattcagggagatgacacaggatttacattattcaatccggcaggttagcaagcacataacctctttaaacactatttggtaaatggtcttgagtttttcttttctttttttgcaggggggctggtgggggacagagtctcattctgtcccccagactggagtgcagtggtgcaatctcggctcactgcaacccctgctgcctgtgttcaagcgattttgtgcctcggcctcccaagtagctgagattacaggtgcctgccaccacgcctggctaatatttgtatttttagtagagatgggatttcaccatggtggccaggctggtttcaaactcctggcctcaaatgacccacctgcctcagcctcccaaagtgcttggatttacaggcgtgagccactgcacttggcttgagtttgtcttggacgcctttctagtacttaaaagaaaaattacacaccccaaagctatcatagaagttcctagaagagttaatgggtgcagcacaccaacacggcacgtttatacatatgtaacaaacctgcacgttgtgcacatgtaccctaaaacttaaagtataataataaaaaaaagaagttcctagaagaatctgtcccttaaatgtagattcaaagcaaatttaaacagagaataagtggcatacaaaatactgactttctgtactgacttaatggcagttttattcctttcatgtctgtaaaatgggaataatggtaaggggtgctttgaagatatttaagattgaaaagcacttggagtctgatgcctttattgttcactacaagtattatctcatactttacttcctccaaaagtttaatttccaactttgtattttgattgtgatgccattgggttactcaataggcttatctttttgtggattttctatctaaaaaccttactacgtaccaaaaacagataagctccaagatccaagtggcacagtacatggaatgaatgccataaatatttgctgattgattgaataaatcattctttaagaataaaagtggcctcactgccatcatttcatctcaccctatatcaactttgtgagatggctgttacccttcttttacagatgagaaatcttaggctcagggaagttaagctacttgcccaacaccacccagcaccggcaactcaaacctgagctgtctgatgacccaagcctcatcatttcttttacctgctgcttctaacttggactttatatttttttgtttcttttttgttttccaccaggaaatgatgaacacaagcccttgagagagtggtttgtcattgtgattatggcaaccatctgcttcatcttgttaattctctcgcttatctgtaaaatgtaagtgttctttacatttgcgtgcttgcagtggggtttcagtactgcatttttacaggcttaccatgcatccggtaggcagagggttcttattatcaggtaaaatttgtggcatttttgtgcctagatgacctgtccaagatgagtgtaggccaaatcaaaagtggaaatgtccagaggtgatttacagaagttggacagagcacacaatgcagccctcagctatcactcactcctacctgaagttgtcgacagcttttaatttctgtgaaggtttctacttgcgggtttcttttgattccttctcagtcttccactcggtccttggctgtctagggtaagctgccagtataggcttttcacagctcagggaggctaaaatcaccacaatgcctgcatgtcatcatcctcagctatcaagtcaccaggcccctgagtggctgatggttattaggtcaaacacggattctagaaatcgcatgtggatctggtatcctatcctagagtccacaaatggtccataagtatcccttacccattttagcattcagtaaggcacaagaccttttaggaggcttaaaaacatgttttgtcttggccctttcataatttagaaaatgagttttataaggtccgggtgtgggggctcactcctgtaatcccagcactttgggaggccacagcgggtggaccatgaggtcaggagatcgagaccaccctggctaatgtggtgaaaccccgtctctactaaaaatacaaaaaattagctgggcgtggtggtacgtgcctgtattcccagctacttggaaggctgaggcagtagaatcacttgaacctgggagttggaggctatagtgagccaagatcgtaccattgcactccagcctgggggacagagtgagactgtgtctcaaaaaaaaaaaaaagacttttctattaaacagctttactattataaacgttatattcggatggcatctacagtttgggggaaggcagtacaaaggagatgaaaagaaagtaaactcggctggggatggtgactcatgcctgtaatctcagcactttgggaggctgaggctggaggatcacttgaggtcaagagttcgagaccagcctgggcaacatggtgaaaccctgtctctacaaaaaatacaaaaattagctgagcgcagtggcatgtgcctgtagtcccagctactcaggaggctgaggcaggagaattgcttgagcccgagaggtggagattgcaataagccacgatggcgccactgcactccagcctgggtgacagagcaagaccaaaaaaaaaaaaaaaaaaaaaaaaagtaagtaaactctgtgagtaaacataattgaggaaggaatgcttcaatcagcaccacccacttgaaatatacagttcgttttcagatattaggcctggtaacacccactgacacaaagcagtttccatttggtcttccctggatgactcagggccacagcagaggcttgcggtacccacaaagtcttcacctataattttggaagtcttggtacgtaaagattttgaatttacaaaacagcaggttctagaatcaaccaggtcaatttttagagtagatatttagagacaaaaggtatactcatgctcacctaattccttctttactctgttttcagatgtcatttatggatcaagttgtttccaccaattccagcaccaaaaagtaatatcaaagatctctttgtaaccactaactatgaggtaatgttgaaagttcttatgatatgccgtatgtgtccagggttgagtcccctgggagctgtcattcggttcttagttttctatattataaggcagggtttttactcagaaggccaggagcatttctgttgcttcagtcattctgttctttggctgattcagttgtttgtattttttaagagatggggtcttgctatgttgtccaggctggtctcaaacacctgggtctaagcgatcctcccacctcagcctcccaagtagctgggactgcagaagcatgccaccatgcctgcttgcctgattgttttattatgcacgttcattactcttctgacatattggaaaggtactgagttataagtgttcttgacagttagacttaaattttaatttcatatcagccatgccttaactgactttggacaatctcttcaaccctctgagttctgaatttctttctggtataataagggacacagatgagattgtacaatgttctgcttagctctaatgttttaagactccatgtttccacatgaatatcttagttaatagagaattttcagagggaactttagctctttagtataaaaaagaccatagaaaaggcaaattattttacccaatatgcattttcttaggcctgttcaccattcagagcgcttaggttcagcccagtggtcacttagttatggctctccaattgttccagcatcatttgttggagtaaatcatcctttccccagtgaattgccttggcatttctgtaggaaattagttgctgtatgtagttggttctatttctggactatctgattggttttatcgatctatttgtctatctttatgccaatacaatactgtcttgattactgtagctttatcgtaaaccacgagaccatttgtggaaggcctccaaaagtgattttttaaaaatttgttttggttattgtaggtcctctgcattttcatatacatcttagattcggctgacaattttctacaaaaaaaggtagctgggatttggggtgagattgtgttgagttgtcagttaatttggggaaaagtgacatcctaagtcttatctataaacatagcatatcactccatttatttaggttttctttaccttctctcagcaatggtttgtgatttttcagtgtatgattattgcactttgtcaaatttatccttaaggtgaacggttatttagatcagggctcaagaaactttttctgtaaagggccaggtagtaaatatttgagggacaaatggtttctgtctcacctcttcaactctgccattgtagtgtgaaagtagccacagaaaatgtgctaatgaatgagcgtggctgtgctccagtaaaacttcattttccaaaacaggcaacaagccagatttggcccgcggctgtagtttgccaacccttgatttagatcaaacagttttcttagcaaatttaggtttctctcaaatgaagtaactcatgattggatgaaccacctggtgactggttgtagggaaaagaaagcgttcgtggaaaaactcaccaaaatgattaatttcaataagtggtgaactttccttagcatttgcagtttgggtattggaaggatttatagacagttacagttactagctgactgaagtagagaatggaggctggcaaaagaatcattctgcccatggttggatctttgtgttctcctttatcaggggaatggcccatctgctcttgttcactgagttctttgggaagaagagtgggccccagggtggagctttggtgcctgttctggatgtgtgctgccagtccctccttgctctagcacacttacccctgagtaaccacatctggttttgtttgtttgagatggagtctcgctttgtcacccaagctggagtgcagtggaaccatctcggctcactgcaacctccacctcccgggtttaagtgattctcctgcctcagcctcccatatagctgggattacaggtgcccgccaccacgcccagctaatttttgtatttttagtagagacagggttacgccatgttggccaggctggtcttgaactcctgacctcaagtgatccagccttcccaaagtgctgggattacaggcatgagccactgcacccagcccacatctagtttaagcagccaactgaagtcatttgtcctggcctcttaatggaacatcttaatgctggtatctaatttccctacagagccccaaaagatttcctttaatattccgaagttggtgaaataaactggtataaaagcttattgtataaggttgtgatttgttgttaattaaaatcaagtcatgtgtgtaaaataacaacttggggcagacaagctggtttcagaataagcagaggatgaatgacggcactccacagcgcctggcttctcaggacaacttattctcttctcacattgcagagtttcacataaaaacaaagcagttagagactgagagaagaaagaaagagcacacagaatgggagaaatgaagtactgcctggtgctgtgggctctatggcctaaattctccacctgagaggggatgagagccagtgcagagctgcctacagctgggccccatgaggccgtgcacagcctccacgtccaaggacaaaagccatccaacccattctcagaggctgtgctacaagggtgacaagagggcacattggtgctatgggcagtggccactgggaaatgtttggctagtgggaaaggaaaccctctgcttttcatggtaatgtgcacctctgagcttggggtgggtgcccaaagtcccaggacttagaggagctctgccaccctagaagcaagtttttgcttgttcagacctcagttagaaatttggacgtcagtgaagggccggtcacagtggctcatacctgtaatcccagcactttgagaggccaaaatgggcagatcatttgacctcacaagtttgaaaccagcctggccaacatggcaaaaccccatctctgcaaaaaatacaaaaattactcaggcacggtggtgcacacctgtagcctcagatactcgggaggctgaggtgggaagatggcttgagcccaggaggcggaggttgcagtgagctgagattgtgccactgcactgcagcttgggtgatgtagccagaacttgccaaaaaaaaaaaatacacacacacacacacacacacacacacacacactgtgaaggaagaaagttggcctttagcagtcaaaaagaaaggcttattctaaaaaagcatatcctgaattttctgataatttacttatttagacaatttttatagagacaagatctcaccaggctggtctccaactcctgggctcaagctatgcgcctgcttcagcctcccaaagtgttgggattacaggcatgagccacgccacctggcctgagctttcaatttatgagactggtttccagctgttccttgtttctacaatggccaagagagggttcctcctccaattaggttgcccgtaaactattaacagtaaaatggataaaggcaggagccatgcctgctgtgtgcatcagtgaattcccgagacacggcactgtggctagtgtggagcagatagtaaaaaatattttggatgagtaaatgagataaaggaataggatctcttacaggcaattttattttttgttaccaattttccaattattatcagcactattcattatagccaaaatgggtcagaactgtccaaagttagggggatactgtagtaaattatggaaggaatatgatgaagctatcaaaagtgatgccgccaaagcacatttaacaatgtaatttacaatcagtgatgtcagagagaaaaaaatcaatttttaaagatgtgtatccggccgggcgtggtggctcatgcctgtaatcccagcattttgggaggccgaggcggggggatcacaaggtcaagagttcgagaccagcctggccaacatggtgaaaccccgtttctactaaaaatacaaaaattagccgggcatggtggtgtgtacttgtagtcccagctacttgggaggctgaggcaggagaatcacttgaacctgggaggtggaggttgcagtgagccgacatcatgccactgtactccagccagggtgacaagagtgagactctgtctaaaaaaaaaaaaaaaaaaaaaaaaaagatgtgtatccatatgacttcaagtaagtctaaagaaaacattatgcctagaaagaaaggcttaggagaagcagtgggctgtgtttgggagatagatgtatggctaggtattttcttcttcttcccactttatttttcacatcttctttgtgaacatttactatttttatttaaaaaataatagacttaaagccaattgtaaagatttcaaagaacccaaaagttctctaaaagacatctaaggaaagatgatttgttttgcagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatatcaccccatatcaaaagagacgacagattttgttcaaatattatattcttgaaggaagccttaatattctggaaatgtgctgaggaagtcattgagcataattcaatcatgaaagggaccactgaatcaagaatgaactttctgaagagatgtttgctgccaaagacttcagaacaacttgttggtcaagtaatgccagatcaatcctagtctctcaagtttggaaaagtttctacaaggccattccatcaaatatcccaatatacacagaaattcttcttcctaacatcttcatatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggaggtgctgcaatagttggcaaaatgtttaaaatgtttggtcactcaaatgattcataatctcaaacctgtttttgttttttttgtttttttttttttgtggggtgggtggtggagacagtcttgttctgtctcccaggctagagtgtagtgatgtgatcttagctcactacaacctccctgtcctgggctcaagccatcctcctccctcaccctcccaagtagctgggactacaggtgcataacaccattcccagctcttttttgtatttttttttgtaaagctggggttttgccatgctgtctaggttcatctcgaactcctgggctcaagcgatacaccggcctcagccttccaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagacagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccattatctggcccttggtatatgtg

SEQ ID NO: 14492 - DNA, 7481 bp, Human
cagagtttcaccgtgttgcccaggctgttctcgaactcctgaactcaagcaatccacccgcccggcctcccaaagtgctaggattacaggtgtgagccaccacgcctggccaaaatatttttatagagatggggtctttcttggctgagcgtggtagctcacgcctgtagtcccagcactttgggaggccacaatgggcggatcacttgaggtctggagttcgagagccgtctggccaacgaggtgaaaccccatctgtactaaaaatactaaaattagccaggcgtggtggcacatgcctgtagtcccagctactcaggaggctgaggtgggagaattgcttcaacccaggaggtggaggttgcagtgagccgagatcgccccattgcactccagcctgggcgacagagtgagactctgtctccaaaaaaaaaaaaaaaaaaaaaaaaaagatggggtctttctctgtcactcacggtggggtgcagtgtcatgatcatacctcaccacagccttgaactcctgagctcaggcgatcctcctgcctcggcctcctgagtaggaggggctatagctgcatgctactgtgcctggctaattttaaatttttttttgtagagatagggtctcctaatctgcccaggctggtcttgaactcctggcttcaaaccgtcctcccacctcagcctcccaaactgctgggactataggctggcactatagccaccgtgcccagcctcttctcagttttagaagagtgtttgttatatagcttcccagtctgtgcatagaccccacggaatcataacctccaggggaggaattagggaatctatttgaaacaaacactgtccactgagtctcaggatctgatgagttccgaaacattagccagggttaagcagccataattaacactttggagtgccctgtggaagctgccatgagatgatggatgtgaaagttaagggacattgactacccttgcacccattcattcaacattcactgcatgctccaccctgttaggtgctggggacaccgacagattaaaggagactcaggctccccttaaaggctcccctagctggctcctcatccttggctcctcatctgcaaaattagatgggtggggcgatgcccaacggaactgctccttaggctgctgagggactacaggggtgggcagcgaagctgtctgtcttgtgggctctggccctgtgaggtctagcagtacagggtccccgcaagctgcctgacctcacagggcccaacactgactcctacccagttcatctcctctcagggctagatgtcaggctctccctatgaagtggatactactattcccattttacagattagaaaacaaagtctcagcgaagagggaggtcacacttcaccccatccccgaaaggcgtccaggacctggtcccctacctccagctgcggcagaggcggccagatatctcgcaagacccgcgtagcgagtcggactccgggggactcggggtctctctctgccgggcccaggaggaggttcctgagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtgagtggtcagggagggcgatggcggcccaggaacactttgggggagtggtaggtggctgggttcggtctgaccccttccctgcctgactccaagcttcggtcccggcaggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagagtgagtggggttggggcgtccagcagcgccctatctactgatgggacctggagccagggaggcaaggccagcagagtgtctgctggaggagtttactgtggccccaagagcccgaatttgtgcgacaggtggattgggagatgcaagagacaaatttctcctgaacaggaagaactttgtgatccaccaatggcttggggatcacaaagtcgtggggaatgctctgcaagcagaggctgtaccctaaagaagtcacagggcagacccttaaggccctctaacatttctttctgacccacagttctctctgctggaagagttagagattggaggaggttatgtatttaggtgggagggttcaggggcgtggtctaagctctgcctctagcactggaactttagctgagaggtgtattcttttcctcctttagttctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaaggtgagggttgctgggacactggagacagggccagaagctgcctcttgtcaggataaatgttaggcttgtggggaggagattaagatattcagtgtttgggtatgagatggcaggtttgtggtcttggccacgcagaatgggtggtgaggagatggtagagaaaggtgggcctgagtttctaactgctacacttggctatatggatgtgaactgaagagctcgttgaacttggctgtttcctttccttctcctctccagaatatgatcacaggcactgcacccctcgacggctgcatcctggtggtagcagccaatgacggccccatgccccagacccgagagcacttattactggccagacaggtactcagagcctgggtaaggatgcaaaagggaagagtggggagttgggcccctctgtatattgtccctgtctctctggcatctacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgaggtgaacgcggggtcaggcagggcagctgctgcagagggtggggctggatgggcacccagagctctgctttgtgtctgggaagtggctcttgataatcgagggaagtagaatggggatttcagagtcctggcacttcccctcaacagggtcgggaccctgagttaggcctgaagtctgtgcagaagctactggatgctgtggacacttacatcccagtgcccgcccgggacctggagaagcctttcctgctgcctgtggaggcggtgtactccgtccctggtgaggactctgtctgttcccacgcactctctctagcagaagcctagctcggggtccctgatatcctgtcttattccctcccaggccgtggcaccgtggtgacaggtacactagagcgtggcattttaaagaagggagacgagtgtgagctcctaggacatagcaagaacatccgcactgtggtgacaggtttgggaagccagtctggagagcagggcctggctgaagggtggccttaccccggcagatcccttgtgccttccctctgtctcacattcgccttccttctccctgctccttttccctttccgtcctaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtgagggctccaggtgacggtgggcagggttgagccaagctctccccagcctccagccaagcccagctcaccgtcattgcttgctctcctccaggtttacatcctcagcaaggaggaaggtggccgccacaagccctttgtgtcccacttcatgcctgtcatgttctccctgacttgggacatggcctgtcggattatcctgcccccagagaaggtacggtgggtgggaggaatgtagggtggaggggggactttttatattacctttgcttcactcatagttccaaagatacactgtgacaacccgagtggctttatttccttaggtggaaaggggctgcttgccgctgctagccaacagaaggggcatggcccatggacttaggggcgggagtcctcatccagtgtgccctaagctgaagcaggttaaaagtttagctctgccagcatgtacccacagaaagatttcctagaaaaggtctcttctttttgagcgtttcattatatatgaaggcttaagaagttctgtgaccaagaaacctgcataacccacaacttcctagacatttttttctcaagaacataccttaggaacactcatcactggtctcttttatgttttcctgtctcaatatgctgtttgcatctgcctgacagcctgggatggatgaagctgtccccaggcagaaccattcccctgctgcattctcccatgactcttaacctccgaggtagccaaaaaagacttaaggaatgaaggcaccctggaggccacgcatgatccttctcttcctactctaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaattttttgatttctcagtgaagttatgtttatattatagttgacccttgaacaatgcaggggttaggggtgtcagccctcctccatgcagccacaaatccacatataacttgtttttgagatggggccagctttgtgcagtggcagtatcatagccaatgactccatgatgacttgaaatataatcagcattggcaattttcgacggtctctatggggaggctgaacaaagggaaaaaaagagatatagggtctcactgtcacccaggctgggtgcggtggcaccatcctagctcactgcagccttggactcctgggctcaaccttggtctccccaactgctgggattagaggtgtaagctaccgtgtctggctcctcacatataacttgactcccccaaaatgtaactagtaacctgctgctggccagaagcctcgctgatagcatacaaacacatactttgtgtgttatatgtattatatactgtattcttaaaactagagagtggccgggcgcggtggctcacgcctgtaatcccagcactttgggagattgaggtgggtggatcacaaggtcaggagttcgagaccagcctggccaacatggtgaaaccctgtctctactaaaaatacaaaaaaattagccgggtgtggtggcacatgcctgtaattccagctactcaggaggctgaggcaggagaattgcttgaatccaggaggcggaggttgcggtgagctgagatcgcgccactgcactccagcctgggtgacagagcgagactctatctcaaaaaaaaacaaaaaaacaataaaactagagaaggtgttaagaaaatcataaggaaaatatattcactatcaagtggaagtggatcatcataaaggccctcattgtcttcacgtttcttaggaggaggccaaaggggagacaggcagactcggtgtaacttgtatttgaaaaaattcacatgtaagtggatctgtgcagtttgaaccccaatcacttaagggtcaacttattaagtgtgtaatgtctaagaaaacttgatttaaaaatacttgagccgaggccaggcacggtggctcacgcctgtaatcccagcactttgggaggccaaggcaggcagatcacctgaggtcaggagttcgagatcagcctggccattatgatgaaaccccgtctctactaaaaatacaaaaattagccaggcgtagtggcaggcgcctgtaattccagctacttgggaggctgaggcaggagaatcgcttgaacctgggaggcagaggttgcagtgagccaagatcacaccattgcactccagactgggcaacagagtaagactccgtctcaaaaaaaaaaattagccaggcatggtggcttgcgcttgtagtctcagctactcaggaggctgaggcacaagaatcacttgaacccgagaggcagaggatgcagtgagccgagattgcgccactgcactccagcctgggcgacagagtgagactctgtctcaaaagaaaagaaaaaggccggtcgtggtggctcatgcctgtaatcccagcactttgggaggccgaggcaggcggatcccttgagcccaggagttccagagcagcctgagcaacataggg

SEQ ID NO: 14493 - DNA, 8596 bp, Human
  misc_feature (1)...(8596): n = A,T,C or G
ggaggagaaagattttgtctttgaatatttctaccagtaaggccagggacctcaccctggtggtccaaactcctcctttcttttctcttttcttttcttcctgagacaagacctcactctgttgcccaggctgcagtgtagtggcacgatcatggctcactgcagcctcgacctcctgggctcaagcgatcctcccacctcagcctcctgagtagctgggatgataggcatgagccactgcatctagctcaaacctccttccctttcctgggctccacttgtctttctccctggagctcaggggcgtgccctccctggttcatccatgaggctgactcccctggctttcctgtctcctctccctgcagatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggtcagttaggagctgtgcccggcccagcttcttgatctgcctgtctgtctgtccatctgtctgcccactcctgtgcacctggcagctcagtccacagccctccccttgtttggcctccagtctgtctgcatccacccctggggtggctctgtggctgccccatccatttcccgctgcctgtttgcccttctctggctttgtctgtctgtccatccagctcaccctggctctgaccctcccccctcaggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaccccaggtgcctgctctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgaccgtgagtcacgcccctgcttccctggagcctgtcccttgcctcacaggcctggctgaggtgggggtgggcactgccctttgtaccccagaattcccactgtcagggcctccctgctcgctgcctccccgggtcctggatatggaggccacggctgccagctggcaggtggctgtccccgtcttggggggggccagcagacccttggtgagtgcctggggtggctcccgggcctcctcctgccccctccccactggcgggtggggtgggaagggggcgggtgcagccggctgagagcttgatgatttcctgccctcgcccggcgctcaccacagcttcctgccgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggtgagtgggaaactggtgggggtacccagggcccagggacaccgacgggatcctcatccactcccagcccctgtgtctgtcctggctctgtccctgcctccgtcctgatcccagcgcctctgagagtccctggatcccagcaccttctgccctaagcaccccctgttcctgcctcaccagccctctctttcccaggctcctacgacagcacatcctcagataggtgagtccgccccagccgccctgggtctccctccacaccccatggcggggcagggctggggcttccatcctccatcttccagccccatccccaagctgtgtctcctttaccagtttgtatccaaggggcatccagttcaaacggcctcgtgagtacaaggagggtcccctaccttgggtgccagggagagggtcccctggtgtgggagtgagcgtgaaccttcagacttcccctgccaccttggggctgcccacatggccttgacctgagctgggagaggggagatggctcccccaggcctgtccagggtgtggggctttcaggggcttagtctgttctttgaggccttgacgatgtccggagtccttctttcaacttggttctgtgtcctcagacacggttgccccctggccacctgcctacccacctgtcacctcctacccacccctgagccagccagacctgctccccatcccgtgagtagctgctcagcccctgcccctccaaagctcagcccctccccctccaaactccactctctaccccttcacttttttggattgggggcccctttcccttttgcaactgctgttgccccctgagccccacctcaggcatgacccctgacctttgactcccagaagatccccgcagccccttgggggctcccaccggacgccatcttcccggcgggattctgatggtggtaagtgtggggaagggttcaggcggcgggggctgggaagaagataggcctggcctgagctgacttagtctccctctcaccctctctttgaagccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcagatgaggatgaggacgactatcacaacccaggctacctgtgagtggccaggtgggaggtgggaggtgagggctgaggctgtgcgtccccccttgctcaccggcccttttcacttcctttcagggtggtgcttcctgacagcaccccggccactagcactgctgccccatcagctcctgcactcagcacccctggcatccgagacagtgccttctccagtgagtcaggcatttgtttttatttttaaatttttttagggataggctggagtgcagtggtgccattgtagctcgctgcagccttgaactcctgggctccagtgatcctcccaagtaggctactcggcctcagcctcccaagtagctgagaccacaggcgcatgccaccacacctagcttatttaaaaaattttttttgtagagatggtctcactatgttgcccaggctggccttaaactcctgggctcaagtgatcctcccacctcgggctcccaaagtgcttgggattataggcgtgagccaccatgcccggccctgttcttctgattttctcagctttctctctcttctttcctatctctgtgtcctttcctttatcatctgggagatttccttgtctgtattcttcaacccttccactgcaattttatttctcctatccagaagctctttctcgttctctggctgttctttttttatagcctcctgttcttgtttcatggatgaaacatctctaaggatgttaattagaggctgtcttgtgtgtctgtgtgtgtcagttttcttctgcttcctgcactgccctgtttcctttgagctggttttctcccttcctcatggtctcatcctgcctggtcacatcctctgggctttcctcaatgtccgggattctttagttttctgttgctttgctctctctgtatatacttgtcctgggctatcacttctataccctggctttgtttgccatccagattcccagtttgctctctcctgagctccagactgtatccaagtacttcttttctttcattcattcattcattcattcattcagcatttactatgtgcctctgctgggctaatgctgtggatataacagttaaggaggcagactgtcctgataaaatagctggctgggcatggtggctcactcctgtaatcctagcactttgggaggccgaggcgggaggattgcttgagcccaggagttcaagaccagcctgagcaacatggcgaaacctcatctttaaaaaaaaaaaaaaaattagccaagcgtggtggcacatgcctgtagtcccagctgctcaggaggctgaaatgggcggatcatctgaaccccgcaggcggaagttgcagtgagacgagatcatgccactgcactccagcctgggtgacagagtgagaccttgtgttaaaaaaaaaaaaaaaagataaaatagctaagattcaccgagggcctcctgcatgccttgctaagagtctgacatgtgttcactcactaatctgactgccctggggctcccgggcctgcccgcgccctcctgtgctccagttgtcccttttgtgggatacagggtttatctgtttaacagcactgctgtgtgacaggccctattttacagaggagaaaactgaggcacagagaggtaaggtcccttggctgaggttatgtggttggttagtgctggagctgggattgaaccggggcggtcttcaaaaacaaacaagaaacacataaaagaaccaaataggccgggcacggtggctcacacctgtaatcccagcactttgggaggccaaggtggggggatcacctgaggtcaggagttcgagactgacctggccaacatggcgaaacccagtctctactaaaaataccaaaattagcagggcgtggtggcgggcacctgtaatcccagctactcaggaggctgaggcaggagaattgctagaaccgggaggcagaggttgcagtgggccaagatcaccccactgccctccagccctctaggtgacagagggagactccatctcaaaaataaataaataaacaaaataaaagaaccaaataaccaggcgtggtagctgatgcctgtgatcccagcactttgggaggctgaggcaggtgggtcacttgaacccaggagttcaagaccagcctgggcagcatagggagaccctatctctacaaaaattccaaaatttagcctggcctggtaggagctgaggtgggaagatcatctgagcccaggaggtcaaggttgcggtgagccgagattgcaccactgcactccagcctgggtaacagagcgagaccctgtctcaagaaaaacaaaaacaaacaaaaagctcccaaataacatggatggtgacaggcgccatgaagggctgacatgggagtgagacataggcagtggctggcagggggcaggtggggatgggggtcggggggaggaggtgcctgctgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctgggtgagtgaccggtgcttgtcggtgcctgcccctgcaccccgctgccccaccatgctctcagtgtgaccagatcccaccctggggctacccacaccctctgccccctctgtctgggcgtccccttgctctctcgccctcctgacccctttgcgtggctgcccctccttctgatctgtccccacagatggcagccgggagtatgtgaatgtgtcccaggaactgcatcctggagcggctaagactgagcctggtgtgttctgcgggaggggcaggagctggggtagctgctttgggcttggggggatagcttgcaagctggagaccaacctcccctcccttacagccgccctgagttcccaggaggcagaggaagtggaggaagagggggctccagattacgagaatctgcaggagctgaactgagggcctggtgagaggcctgccctgtccccaccctgccctgggcccacaggctctactccttccctccaggacccccttgcccaaccctacctctggcttgtccctctgtctctgggtacctgctgacccccgtcagcctcctgatccgtatccctccctgccctggtgtgtttcagtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagtaactgaaaaagttaatatgcagcacagcacttttgagactttgatgggtaggtgactcaccggcagactttgctgtggggtgggttctgactcagttcgcctaggacgtggcctgagactttgcatttctgagcctctcctgtgtgattctgatgctgctgttctgtgaacctcatcctgaggagcaagggcgtggtgagcatctattgcctttacttgtccgggatccatttccccttattttgggaatttcaccttggctttcctctgcaattcactcctttcccaatctcattccatgtagttttagagattgtgtgtttgttttttctttttccttttttttttttttctttttttgagatggggtctccctctgtcgccaggctggagtgcagtggcgtgatcttggctcactgcaacctccgcctcctgggttcaaacaattctcctgcctcagcctcctgagtagctgggattacaggcccccactaccacacctggctaatttttgtatttttagtagagatgggtttcaccatgttggccgggctggtctcacactcctgacctcaggtgatcccaccctcctcggcctcccaaagcgctgggattacaggtgtgagccactgcgcccagcctgttttttcttttttggaaatgaggtctcactctgtcgcccgggctggaatgtggtagtgcaatcatgcctcagtgcagccttgaactcctggggtcaagtgatcctcccagctcagcttcctgagtagctgagactacagacgcatgccaccatgcccggctaatgttttattttttgtagagatggaggtctcactgcgttgcccaggctggtcttgaactcctgagttcaagtgatcctcctgccttggcctcccaaagtgctgggatcacaagcatgagccactgtgctcagtgtctccctgggatttaaggtgaatgatcgcatctggcctggagattgttgaacacgtgacccagacctgggccaaggtcaccatcctttccctgcccatcacgattggctcaggtatgggcatgtcacccggcctgggccagtgaggagcagccctgggatccaggtgggaagtgctgggcaggagaagctccatctgttcggggcagtgattaagctggacagatgcaggcctggagccaccacttggagagcctgcctaggaatgaagccaacgtgnnnnnn

SEQ ID NO: 14494 - DNA, 12097 bp, Human
  misc_feature (1)...(12097): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagctggctgggcagaggggctcctcacttcccagtaggggcggccgggcagaggcgcccctcacctcccggacggggcggctggccgggcggggggctgacccccccacctccctcccggacggggcggctggccaggcggggggctgtcatgagtcttgtattatccattttattattccttagtgcatggtaaagcttcctttaaaatgcaagctgatttatttgagccagaggaccccaggggaggtgagatagatacccacacctgggcagaggattacagggaaaacggcacccgctctttcccctgggcacatgtggtagaggctgtgggaatgagggtattgcaggggtgatgagggtagagtcaggactgtaactcctcattccaggttccccggagctttgactgttgtgctcctagcctcaagcaatccttctgcctctgcctcctaaggtgctaggattacaggcctgagccactgactgtcctcctcctaggaggctgttgactgagaaggtctggatgtcaaagcctttcaccacaggatatagccaagattactgcagagccaaggcccaaggccatccttccctatgcacagctcttcgtaattcccctgacttctgtgtgtgcaacttgtaagcagctcagcctggagtagaagttggggttctgactttctacagcacctgggacgggaaggatcagaggagcacagggagctgactgccttataggtgtctcacgtcatcccatctgaccctccaacaagcatgtcaggctggcattattcaccccattctacaaagctcagagcagtgaagggccttgcatgtgacatttaccatcatcatcactagtatgtccctactcacatcacagcaattctttgctcaaatctgtaattgctgagactcgaagtaaaacccaaagtcttcacaatagcaatagcctgcaaagctctgcccccctcctctcttctctgacctcctcactgcccctgtcttactcactctgctccagccacagtggcctccttgctagcagttccctccccaacacgcccggcacagtcccacattcccgccttgctctggcttccgctgtggctgtttcctccccgcagaacactcctgccttcctcaccgccaagtctggactcaaacctcacctcctcaagaggcttgcccagacagccttttatattctgcaaactgcctcccactgccacctgcccccttactttttgtggccttgacctttcaacatactacatgatttgcttacaatacttgtctgtcttgccttcaccagaatgtaagcgctctacaaaggcagagggaaggctatcttgctctctgatgtatcctccagcccttagaacagtccgtggtacttagcaggttttcagtacatctgtgcccggcgatggaaagaatgaatgaatagtgagaccgaagatcgcggccgtaagcctctgggcacgggtgccccggggcctggcggaacgctcagggaactacatttcccgtgaagctctgggcgcagagggccgcgggggctgccgggaaaggcatacgtgcttaatcctggtgcagggggcgagcatggccgctccgcgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagaggtgagccccgggctgtatttcagcccactttacccgcaggtcaggagaaagggcctgaggcaagtcataagaatcagctgggaagggtgaggcagcaaggagggaggagacccacttggctcttcaggctaatggactagatagtgttatcaaaaagaagagaggttttgtcataataggctgggatttccagcactctccttcccccaaccactcttagcacttagtgaattttaattcagccctctttgacaattaagtttttttactttgactatttttttgcatttttattaacctaaaatatttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactcagggtggcaggtttcttcccccttcccctcccaagtttcctgtctttccagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggtaaaggacagagtacggtgcagaggtcagggtacagaagggcttatgctaaggccctcccgtgacttttactgccacttttaccccacccatgccaggctcctgcccaaggccaaatccaggctgacaactcccaatttagctctgcaaagccagatggtagggacacatgcagcaactaagtctaagcaaacagctcaccggcctgtgccaggggagtttctctaagctcattccaaggggcttgttcctggtcttccctcatccaacccatgtctattcatatctgccatttactcatctgctttcaggaagagttcaacttgcaaggcagggcaggtaccctcagccccacccccatggagtctccctacacaagccggagtcccatcctaagcaactgtggatcaaaactcctttttttttttttctgagacttgagtcttgctctgtcgcccaggctggagtgcagtggcgcgatctcggctcactgcaacctcctcctcccaattcaagcaattcttctgcttcagcctcccaaatagctgggactacaggcacgcgccaccacacccagctaatttttgtatttttagtagagatggggtttcaccatgttggccaggctggtcttgaactcctgccctcgtaatccgctcgcctcagcctcccaaagtgctgggattacaggcgtgagccaccatgcccagccaaaactccttatttctagatacacaaagtaagacccagagaagggagggatttaccaaagccacacagcttgttagtgtcagagcttggtctggtatttgggtttcctgattcacaggccaagcctcttaaagtctgccccagcttttccctgatttgccccggggttgcccctgatttgcccctgccctgggttggctgagccccaagtttctgcaacatgctttgactgggctccttgccagaggtaggtagtcactgccatcctgcaactggggagggtggacagcaggggctaggtggcactggtgtacctgctaggtaatggctgtaccctcaccatcctcctcttcccctggccaccccacaggagctggcagagaagctgcacctccaggctccgcagcactaccccgatgccaaccacaagccagagatggccattgccctcacccccttccagggcttgtgtggcttccggccagttgaggagattgtaacctttctaaagagtaagttgggcagaatgctgaaggcatgcgtactgggccagggatacctggggaaccaagatgataggaacagtggctgagaacgggtcacatgtcacaggaactgaagggcctcatgaagcagtttttggagccagtgagccaggccagtgagaccaggctcaggtgtggtagtcaagggctggtggtgagtgattggtttccactgcaaagtttacttagcattgccggctctttggttagggctgggatggaaaggtgtcctccaactccccacttgtgtgggttccatcttaccattcctgatatgggccctgggccttgccttcctgtagaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacggttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgactgtgatgggtgtggtcactgtcaccctaaaggtggggagtcaacacaagcagtaagaaacccaaaacagaacagactcccagcaatgagcttatgtggtgcaggcgatgaggtctcagcttcttagcctggcagccacaaccccttctctaggtggcccagagctctctttttattttacctctacaggtttcccattacctttgagccttagggcattatttatttgacccaagcatatttttttctggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgttttctgagccagggtctctttctgttgccccaggctggagtgcagtggtgcgatcttggctcactgcagcctcccgggttcaagcaattctcctgcttcagcctcctgagtagctgggattacaggcatgtgccaccacatcttggttaagtttttatattttagtagagacggagtttcaccatgttgcctaggcgggtctcgaactcctgagctcaggggggggacctgcctcagcctcccaaagtgctaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagggtgcggtggctcacacctgtattcccagcactttgggaggcctaggtgggaggatcccttgagttcaggagttcgagaccagcctgggcaatatagcgaccccctctctctgcaaataataaaaaacttagccgggcatggtggcatgcacgtgtggttctcgctactcaggaggctgaggtaggaggattgcttggtcctggacagttgaggctgcagtgaggtatgatcgtgccactgcactccagcctgggtgacagcgagaccccgtctcaaaaaaaaaaaaagggaaagctcgggcatgttggttacccttcatgaaactcttttgcgttatctccctagattttgagctccaagggcagtggttctcatacaggggacatttggctgttgtctggagccattttttgattgtcaaaacccagataggggttgctagtggcatcttgtgggtggaggccagggaagctgctacacatccatcagtacacaggacagcccccacaataaagaattacctagcccaaatgtcagtagcgccaaggctgagaaatcccatcctgaaaggaccatactctagctcttttagtggctagtatagtcctgggcatatgaatagtcaagatatgatgaaagatggtatttgtatggactggagtatcaagcaaggctcgacccccaaagggctggaggcgtggccagaaggacagggccactttggcttctggattcctgtggcagggaccttttcctaggactccctggccaatgtggggctatgaacagcactgagtatccccctaagtgaccttggggtgctctgtgaccctcagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtgaggggctatgatgggtgtccttcgtgtgccatgaaaatctctggcaagggtcacgatgtggaggacacctggggctgggtttcctgtcaagcccacttggcggagggtggccccagggcctgcccattccttcctgtaccagggaccaggcctctatgctgactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtgatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgaggctgtggggtaatgagcactcagcctttggggtacctgttcctaaagtgggccaaaagagccctccctacatgatgccccagtttttgctttattcctatttcatacagcttctcgggggggtgagcaggctacactccagaacaccggtatgggaaggagtgggagaggaagccagctttggcctcacaggcacagcttgcaagcaggccttgggtctgcccagaggcacagcttgcaagcagccctacagagaaggtgactcaaaggatacaccagtcaccagtgcaagactcttcgctcctgtttttctcttttttttttttttgagacggagtctcggtctgtagcccaggctggagtgcagtggcacgatctcggctcattgcaagctccgcctcccgggttcacgccactcttctgcctcagcctcccaagtagctgggaccacaggcgcccaccaccacgcccagccaatttttttggtatttttagtagagatggggtttcactgtgttagccaggatggtctcgatcttctgacctcgtgatccgcccacctcagcctcccaaagtgctgggattacaggcgtgagccaccacgcctggcccggctcctgtttttcaactggccctagaggaggggtccgcaaaccaggctggcaggccagttctggccatacctgttcatttccatactgtctggctgctttcaagccacagtggcaaagttgaagagttgcactagactgtacggcctgcaaaactgaaaccattgactgtcaaccacttctctacaacatactcaactgttgcagattacagggactcaggaaccgaattagacaattttcatggcgaggagaagcccagttagctttcctaaacgggcaggaagtgtgaaggagggaatctcctgatgccctgctccaggggtggcacacacctgcaagaggctgtcggctgtctgctgctgctgaggtttctgacctgcaatcgtagatcctgtcaccacagactaatcacttagtccactggctccttcctgtgggataaaggtttaaattcatgcaaaagaatctttctgggcttctgcccacactagagtccctatacaatggagttccaggaaaccaccttcaaaaatctcctgggttttcttgcctccaaattttcttcagctaaaaaacaataaagatgagctggaaagaaaaggtctgctaaagggaacccattctacagaagtgacttgcaagagcctatttcactcatgccgtccagtgaaacaggcccgaaagtgatgcccagtgggaacagcagaaaggggagggagtttccagaaggaattgctgtagtcagctgttaagctatttcttcatttcaggatatccaggatattcttaacttttatttttttgagacggagtctcgcactgtctcccgggctggagtgcagtggcgcgatagctcactgcaacctccgcccactgggttcaagcgattcttctgcctcagctcctgagtagctgggactacaggcgcctgccaccacacccagctaagtttttgtatttttagtagagacggggtttcagtagagacggggtgacaggatctacaattccaggtaaggtcaggttggtctcaaactccggaccttgtgatttgcttgcctcagcctctgaaagtgctgggattacaagcatgagccattgtgcctggccaaggcctttaaaatccactgcaacacagacacagctcaactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggccctaaacaa

SEQ ID NO: 14495 - DNA, 5300 bp, Human
gaaagcagtgtgactcctattaactgaccagtagtcaatttcaactacccataaatatgtgagtgtcttgtatctgtaatcccctatctggtgccatttttggaaaccagttaagactcttttatcctaaaaaaatgaactatgttgcatttctggaaagtaattattgatgaaatactccctggagagtctgaagcccctgatattgtatatttaatggttatcctccttttaataaaaggtatgggaagaaattttaaatattattcctaaataccttacatcgagatgagctagagttaattaagtgggacgagggataatgaattcgagggcatttaagaaagattaaagaaccaatgcaaaatgttttaatcaggaaagaaattggtgtgtttaatgacagaaaagaagtcagcagcatggcaggagctggggggaggtcggtgagtacagggcaaacttgaagaaggcaggaaggcatcagaccactcagaaccttactggtcaaggtaaattatacagaattcaacataaagcttaacaggagacactgaggttttcaacatttgacttctgtagtaatcagattcgtggctgtgtatctgtgtatttaatcaccctggtcacaaagtgaagaaataatggactgtgcagggaagacaaaatgttacctcttccctcttagggtttttcggctgggcctgagaatggaacagattaacaggaggaaagcatacacatgtatttaatataagttttacatcacatgaaaggccccataattaaaggaagacctgaatatgcagttagaattcaatactcatatactcagttgggcaaagagtcatacattgtggaaaggtgaaaaaggggcttgggctagggttgctggttgaatggcaaagtgactaggaaggtgagggttagtttaacaagcttttttggtatagattccttggcctcaacatcatcccctcctacccttcatgttaagaatgttctttctttctggtatagataagacatcttttatatgggaggcttattccatttttcaagaagaaaaggggaagggtcagagtactcctcttatacctgctattgtctttaatgactctagctcaaaataatccttatgccaaagtggcatattttgggcggagggttgggggcttatgctgccaccctccagcagtgtggacagagttgatgcggagaaaaaagttagctcaggcaagcagtagtttagctgggataatgatgatggtgttagaaatatggggaaaatgagacatttaaaaggaagaaaatcaaaggacttggcaattgattagacatgagcagcaatatgcagggggtggggggtggtgattaagagactgcgacagacagacaaataaggaggaccaagtgggaagaagatcaagatttactttgagattgggagtgcctttgggacagtaatctaaacaagaatatgcagggagcagttggatgtacaagtcatggactcagaaaatggatctggataagaagtacacctttgggacatttagcatcactggaagaatgaaagtgcctccaatcccttgatatagagtttacaatgaaaaaagcagagaacataggatagagatttaggcagcacacctgccttgggggactataaaaggttgagggaggcaaaatgcactgataaaccaccatcggcattagactaatggctgagtaattgtgtaagtaattgctagtaataatgctgtggagtacgtgcctggtaccacaccaagtgctgcttttttcttaattccgctctgatacttgggatgcctccctgctgcctcgctgcggggcgggccactccccacccaggcaggccgaggcagagctcagcgggcatcggatgaattcgcccctttgaccactagagggtgatgtggatctttctgtaaaatatctgctgctcatcaagtgcggactcaagagcttcacctgtgttcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctacactaactttgatgctgagcgggatgctttgaacattgaaacagccatcaagaccaaaggtgtggatgaggtcaccattgtcaacattgtgaccaaccgcgacaatgcacagagacaggatattgtcttctcctaccagagaaggaccaaaaaggaacttgcatcagcactgaagtcagccttatctggccacctggagacggtgattttgggcctattgaagacacctgctcagtatgacgcttctgagctaaaagcttccatgaaggggctaggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgcccaggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggtccagcgcattcagaacaagcccttgtattttgctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattacatccagcaagacactaagggcgactaccagaaagcgctgctgtacctgtgtggtggagacgactgaagcccgacacagcctgagcgtccagaaatggtgctcaccatgcttccagctaacaggtctactaaacatacaaaagtttagccgggcgtggtggcgctcgcctgtagtcccagctagtccggaggctgaggcaggagaatggcttgaacccggaaggcagagccgagatcatgccactgcactccagcctgggcaacagagctagactctgtctctaaataaataaataaatgtaaggggcgcggtggctcacgcctgtaatcccagcactttgggaggccgaggtgggcggatcacctgaggtcaggagttcaagaccagcctggccaacatggtgaaaccccgtctctaccaaaaacacaaaaaattagccggacgtggtggcgggtgcctgtaatcccagctactcgggaggctgaggcaggagaattgctggaacccgggagtgcagtgagctgagatcataccattgcactccaggcagctgggcgacagggtgaaactctgtctcaaacaaaaaaaaaaaagtttgaaataagtaaagatatacaacatgatcatgaaaaagtgaatccaataatccaatagtaagtttattttaatttctgcagtattatctatatattcaatacgacagtaatcaaactacaaaatatttatttcatgaaatttggcatataatctacaactaagtgaaaaagaagaacaaaaataagcattatttaagaaggacagaaagtgacgtgaattgctctaccaattatcaaattatgttatcacttaggataatgaaagaagcgtgattggccgggcgcggtagctcacgtctgtaatcccagcactttgggaggccgaggcaggtggatcaggaggtcaggagatggagaccatcctggctaacacagtgaaaccctgtctctactaaaaatacaaaagaattagccgggcatggtggcgggcgcctgtagtcccagctactcgggaggctgaggcaggagaatggcgtgaacccgggaggcggagcttgcagtgagccgagatagcaccactgcactccagcctgggccacaaagccagactccgtctcaaaaaaaaaaaaaaaaaaaaaaaagaagcgtgattaaacaggcaaatggaaaagagaaaatgaaaaataggtccatgaatatataggaatttcacatatgatagaggtgttattgaagctatatggaggaattatgtaatatacaataagttattctggaacaggtggttatccatacaaggaaagatgaatttaaaccttacttcacaatatatgctaaaataaatcacaagtggattaaatgcttaaatgcaaaattcaaaatgttaggtgttttggtaaataataaggattatatcttcatgaatttgggctatgggttttttttatataaagaatttaaaaacatgttcaccccaaataaaagaataatgcattctactaaattaagaaatccaacaaaaagtagcacaaagagagtaaagacataaaccacaaactggaaagatattaggaacacatatagctgacaaacgttgggtatccagagtctataaaatctgttacaaataaataacagttaatcaaccaaaaagaaatatggacaaagggcagtttacagcaacactggtggcctataatatataaaatatgttcaaccttcttagcaaccaggaagaagcaagctaaaactatattgtaccatgagataatattaacaaactagactggcaaaattaaaagtatattaaatagcaagtgtagtcctagatgtggaacatttgaacacactcatgaactgttggtgggatcatttatttggcttaatcactttggaaagcattttgttatgttatgaagttgacatgctgacttgaagactcagtctttacattgccaggtatggcaacaatcttccacctaggtaagcagagacatgttcaagaataccatactgtttgtagcagcacaaacacccagggaaaaattagtgtgtattaattcaagaatgaatcaattctagccaatgaatataacgtaatactagatagcaatggaagtaaattgtctagattatgtgtcaacatattatcacagacctaatgttgaatgaaaaaataacattacagaaaaatatataaactagctgattcctcttagacacatttcaaagacacacaaaattaaatactacataa

SEQ ID NO: 14496 - DNA, 8773 bp, Human
ccttcccgctaacaaggagcaggcctcctcatcagtgcctgataagggaatgactcagagctgaccagtcacagggtgctggcttttatggctggtcttggactcccctttctccctcttgggctctccaaagaccttcagtctttctgcaactgattcactagttaaacagcctcagactggccttcctgagggctcagagcggttcctggtgggttaggggtgtgtatttacggggtttcctgccccagttcaaggatgagttggcagctaacaggtagtttgctgggaacttaggtttccgaggctggagacaagtctccaccagtcacaggtgacccaggtgataatacacagagaagagggctgagctgggccacccctcttttcatgagggaaaactgagacccagagatgggcagggactggcctgtctcccttaataccttctcaggagggcctctgttccaagcctgggtgaatgctttgccataaggacaagaaggaaccatggggacagttctggggacgggggtcactggggacaggaactggggtgaggttgttgcagcgccctgtagtgcctggcagggggcatggccctccaaagagatccaaaacggtgggtggaattgttgaacagagcaaggggtggggctgtgtggggaggaaggccctgcctctattgtcaaaacctttaccttgtgccgggcactttgtgtcgctctgcccagctcattcaagcactcatctttatacaaggatgaggacatgcattcagcagccctctgacaaggagggcagggattcatcctatgtttgcctttcagtggcagatgctaaatgcctcatgggcaagttactggcctctcccaggctctgcttcctcattttggaaatattaaagcagcccaatactcctgtggttgaatgaacgcatgctttgggggatggaagggaggggatcatcctggtggccagggacgagtgggctttgagggttccagagtgaggatcaggctggagcttagtgttggaaaggtgtcagctgccagaaccgctccctgcagctgttctcaggagactgttgtcacctggggcactgaatggcgacagcagggtgaggcagctttgtcttgagagggctgggttcgtgcagctcaaaatgcccggatgtgccctcatccggaactggtgcctttgtcagaggggacaaaaggggagttgggcatgggtgttcccaagaagctggttctgagaggctgtaatctccagtggagggcaggaatctgtgaatgcactttgtggggggcgggctggttaggatcgcaagcaaggggctcttaacagggagcactctgaatggttaatcactggggctgggcgcaggggctcacgcctgtaatcccagcactttgggcggcccaggcgggtggatcacttgaggtcaggagtttgagaccagcctggtcaacatggtgaaaccctgtctctactaaaaatacaaaaattagctgggcgtggtggcgcgtgcctgtaatcccagctactccggaggctgaggcaggagaatcgcttgaacccgggagatggaggctgcagtgggccgagatcacaccactgcactccagtctgggcgacagagactcgtctccaaaaaaacaaaaacaaaatcactgggtcaggggtgtgtaggaatatgaccccagagggactgtaattcccagtggtgtcaaactctgggtgatcttaaagggtgaggctcagaatgtggcttccagggacaggggtgtccaggtatgtccctgacgggggaaaggccagaacagggtctgcagagagagagtgggggagtgcgggtcggagcttctgcgcggaccggggcggggcacctctggagggcaggggcctctggtctctgggaggggagggaattgaccaatggggagagagcccatatttgctctcaggagcctgcaaattcctcagggctcagatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaaggtgggcggaggcccggccgcgggaagtgcagtgcacctgccgcggaaacccagccccgcgggccgggcgaggttccaggcggggcggcgggcaggagcccgttaggacgtgggaaggtccacaggtggggccgagtaaagggggacaggagacgtgcggggcaggacctcggggctggatgcagaggccggggtggtggaaaggggaggagaactgggcagggcagataagtgggtggggcctctggaggtggcgggggcaaggttggagccccgggacgaagaagggacgcgggtcagcgaggcctgaagagtgggaggagatgggacccggctgtagagtgcccagaggtctaggccaggggccgcgctgccgcaggaagatgcgagagtttggctttggtgatctggtccacccggggccagtcttgccccctctgccaccgcagcgtagggcctcctgcattccgtttctctggccggaagggtctagtgttcatccctctcaggctttggcctcctcccactctcccgccctggggcccattcgtttaggaagaatgggagagccggtcgtggcccctgggcggggtaaaggagggaggcttggtaaacctctgctggggaggacccagtacagtggcagctccttgtcggggaaagaacggatctgcgtcacacgctcttacaggggaaccctaaggggcctgaggggtagggcttggtctccacccagagggaaggagaaatttttcgagtcgtaaagaaatgtatcagaagccatggaacatttacagccgcacacgctgggtctcccaacaaacagatccccaaaatattttccagtgctgtactcgtggcatagacccagacccacagaccaggaggaagcgctagagatgtcaacagccaacaaaaacagtgctttacacacttgtaaaattgtgacctacaggggctgggcactgtggctcacgcctgtaaccccagcactttgggtggccaaggtgggaggattgcttgagccccaggagttcgagatcagcctggcaaacatggtaaaatcctgtctctactaaaaatacaaaaattagctgggcgtggtggtgcatgcctgtaatcccagctacctgggaggctgaggcaggagaattgctggaacccaagaggcggaggctgcagtgagccgagattgcgccattgcacttcagtctcggccacagagcgagagtccgtctcaaaaaaaaaaaaaaaaaaaaaaaaaaaaaggaattagcttggcatggtggcgtgtgccttgcagcgagctgtacgtgatcagtgccactgcactccagcctggggcaacacagcgagaccctgtatcaaaaaaaaaaaaaaattgcgacaataagtacattttactacgcacccttacgcattctttttctcacctctgtgtgtgtgtgtgcgtgcacatgcacacacacaaatgggtgacacaattctcaccatactaagagaaatcccctctgatattttgtagcctattctgttgcattaaaaaactacacaatcggccgggcgcggtggctcatgcctgtaatcccagcactttgggaggcggaggcgggcggatcacgaggtcaggagatccagaccatcctggctaacacggtgaaaccccgtctctactaaaaatacaaaaaaaaattagctgggcgtggtggagggcgcctgtagtcccagctactcaggaggctgaggcaggagaatggcgtgaacccgggaggcggggcttgcagtgagccgagatcgcgacgctgcactccagcctgggtgacagagcgagactctgtctcaaaaaaaccccaaaaaacaaaaccaaaaaacccccccaaaacacaaaactatacaatcaccacctggtgccttgactaatgagtgatgacctgctctttgaaaaacagaacacaattaccttattcaatgataagctggctgttgtgaatgcgcctcttaggtcagtaagacctcaggttggggtgaacttggatgaggcatcatcctaaactttagtttccacctctgtaagataggagtacccactgacctagcagtgaggttccagaagctataaaagatgagattcaaagtgcctggcacataattgatactcaacaaatgggattctcttccctgggggcaaaatatgcttcgcatagtggggggggcaggtatagacaaaatctaccccccatctggtttatagacccccttcaggccatttagagtttcattgcacacaggtctcagagatttcctccccaggcttgccttcctgccctcccccacccaagtccccctggctccagttttcttcctgccccagcttctgggcatggactgtttgcaaggcctcccagagagcgggccaatgggcggcagatgctggctagggctttggtctctagggtgccggggtatattcatttgctcccctctctcttctgggaagaaagtgagtgggcagtgcctgtgtgttgaactggtaccaacctctgcctctgccttccagattcttggtgccaccattgagaactccaggattgtcctgcagatcgacaatgcccgtctggctgcagatgacttccgaaccaagtgagtgtctctgtcctgggggctgcagaagccaggactggggtaggggttggggggtttagaatctgccctcacctagcctagatggcctgaagctaacccccctatggactcctgaactctggggaggtagggaagtcttcagagatgctgaggaagctctgcctggctgcaactatttcctttgaaaggtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgatgacccagtctgtcccccagtgctagttactaggcctgcacctgaaaactaagcccctttagcctgaagggtggggaagtgacctgggccaggcccagtggggtctgggccctgacatgcccatctctgctgtatctttacaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggtaggtagagggaagcaggcaccctttgggggttaggaaggggagggctttgtgttccctacgcgaaggtctgactcaatgcttattccctcttcttcctctctctgcagactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaggaaggacgtttggtttattatttcagcccatggagagaataggtcgttcggtttgttatttgagcccatggagagatgggtcctgccttggccctgtttaggttttatttgaaccaaagttcactctgtcccaggaaagggaggggagggtactcacatactttgcctgtaatggtaattcctgtttacagaagtcttcatttatttaacccgttccttaaaataacctcatgaaataagcattgcttccattttacaaaagtaaactaaggctcagagaggtgaagtgtttttttctatatgtaactgctctaatgcatggcaaaggtgggatttgaaattgtttttgcttctagatttagttttctttctactctactccccagggcgttgaggtatctgtgtgaaattaatgtttattgaacacctactatgtgccattgaattaaaaacagccctaaaaggtagtatgagctgcatgttatagatcaggaaataggctcagagaggttcagtaacttgtccaaggccacacagcaactacatggtagagccaggactagaacctaagttgcctgattcttagcccatggtgccagcccctgccaggtggtctcctggagttgacgccacttgtgccggtcttgctgacattccagtcttgtgccctatgaaggctcaggccggggatccctaggggcagttcctcccgacacatttctccacctcactgaaactgggggtttggggccaggcatcccgcttggagcaaggctggggaggctgtacctgtcagtgtgtgttgtgtgtgtgcatgcactaacacattcacccatttttggggcagccctgcataagccctttaacgcccaccagcccatacctgggcccagagcccagaatgggacccagcagtgacccagacctcccacagagaccccaaccctggcttgcctggggcctgccctgggccagcaaaagaacgaagtcccagcttcctggtacaactctgcccttgggtaggtatggccctgctcctgtggtttacatctcagctgccaagaactgaggccaattcaaggtaaggaagaggccccaaaagaagtcccacttcttcctggtggagaggtgagggctgcaggcccaaccctatgagtgatgggggcaagtgagggacactagttccacgcccgcatgctgccaaatgtactcagcaccctgctaaggaggccggagaccccatcacggccatggcaatcccgaaggaggagctgtttcaaggttggttatgaacatgtaaccccagagccccgctgctgtagcctggactgggacccccttctgccccctccctagctgtcctgttctggcctccagcacccacaaaccaccacccccaacttaacttctcaggaagccttggagctggagggagaggcctggctgcacccccagctgggactgcccagaggcgcttgtccctgcccatgaaagcctcccttgtcacagctgaaaccttccctctgcctcaggggcccctggaatgtggctgcggggcggggtctgggcccacacaggtggggcaggtgactgtcaggtctcaggcctgagtgtcaggaatgaagcctgcctttgtgtgtgcacagtgcagggtggggctggactggggacacttttctgtctcagcctggagacctgggataggagggagaggggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtaagtctctgggctccaggacacaccccctctccctggcatttccctggggaacaggagaggtgtgggagg

SEQ ID NO: 14497 - DNA, 8346 bp, Human
cctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcggctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccatccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttggttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggcgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctg

SEQ ID NO: 14498 - DNA, 19861 bp, Human
ggtttccctcgaggaaactgggcatctgcactgtaagggcaggcagatgcagtcacagagggccttgtcacccccatcgcccatgtctcctccatttctgctgccacgtggtaggcaccttagtgctgtacctgctttgaatctcatctcccaccattcctctgagcaccctgccaagttaatcttgagatattagttttgtctctcctgacacagaaatgtggccagtgtttcaccttcatctggcagccaaggccccttatcattggtccatagtaaccatccctgtgagctctgttcatatctccttgccttctccttgatggtgatctgagtccaggagcaccacccagcccttctttcttccccacatggcctatgggtgacacgtaccatcacgttgactccctgcaccatccttctgccacctttcttcacatcccctttgcagatccccttgaccacaccctcattctcagctggtgctcatgaaggacagaagagtcaatgtcagtacaatgtgagtgaagggctgaggtatgtcagtgctcccagtgggcacccgggcagggtatggtgcatttacacagtgaggggtgggggaatcagtaacatgtgaggagcccgtcatgccgccacgtgggagtgtcctctctcctgctcacagggagtagttaggactggagatgagcccaagtttgtgaatcttaacaagggtgttgatgcctcaagactggacataatcaccaaggaagttggtggcagtgcagaagtgcacactggggtgccaacatgaaatggggaatgagaggctaggagggagtagctggtgcaagtaaagatgggaacacctgctgtgggtgctgccaggatggtgcaactcagatagaactgaccactaggatttggtaggcgttgacacataatgatgacatgtggggctgcagcacaggctgcccctggctgttcaccctttggagctgctgttctcccactctaggtgggtctggcctgcccagcttcagagcattgtgaatgtcagcaacaaggagtgagaagagtggtcacagcaggatacaggcccacagcaggatacaggcccacagcaggatacaggccccacaacaggacacaggcccacagcaggatacaggcccgcagcagggtacaggcccacagcagggtacaggccccacagcaggacacaggccccacagcaggacacaggcccaacagcaggacacaggcccaacagcaggacacaggcccaccaggacacagccccacagcaggacacaggcccaacagcaggacacaggcccacagcagggtacaggcccacagaagggtatggcccacagcagggtacaggccccacagcaggacacaggcccacagcaggacacgggcccacagcaggacacagccccacagcagggtacaggcccacagaagggtatggcccacagcagggtacaggccccacagcaggacacaggcccacagcaggacacgggcccacagcaggacacagccccacagcaggacacaggcccacagcagggtacaggccccacagcaggacacaggcccacagcaggacacgggcccacagcaggacacagccccacagcaggacacaggcccacagcagggtacagacccacagcaggacacgggcccacagcaggatacagaccctgtgggggctgccctcctatcatggcaggtctgggcaccatgacccactttaccttagggtcagcatcttgcccctttgtactgtggccctggcttttgagtctgtgtctccatggctgactccctctttttaggtccaagatcaggaaacatagcatcagcccctgagacctggcagcaccaggccctcttcaggtcttgggctgcaggggtggaggaagagaccccggcctgatgggaggatgaatccctagagctagcctgtctgtagactcacctgtgttcttgccggttttcaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccaggtactttaagaacagttctccgctggtgcccttattctggggaagtgatgtccatggaaccctgtgcttacccctaggaggcatctgtgtcatcacaggtagggagggtgacggggtactctgactcaaggagccaaggctggatgtcagcaaggaagttaacctagcctggcccctggcaccttgagcagaactgtgatttccccacttgacacgaagaggtatgacatgatggccaccagcgtcctttgatttgccctatactcctgaccccttcccaattcaacaaccaggctggtggcagccctctcccctcaggactctactctggtccagggctttgtactgtggttacccatacagttggccatctaaagcctaggaagaaaagctgaggagtttcttgtggggaaatagaggcattcaaaagcacccttggcccgggtgtggtggctcatacctataatctgagcactttgagaggccaaggcaggaggattgtatgaggccaggagttcaggaccagccagtataacatggcaagaccctatctctactaaaaaattaagaaaggctgggtgtgatcactctcgcctgtaatcccagcactttgggaggccgaggtgggtggattgcttgaggccaggagttcgagacaagcatggctaacatggtaaaaccctgtctctactaaaagtacaaaaattagccaggtgtggtggcacatacctgtaattccacctacttggaaggctgaagcacaagaattgcttgaacctggtaggcaagggttgcagtgagctaagatcatgccactgcactctagcctgggcaactggagtgaggctctgtctcagaaaaaaatacataaatttgaaaaaaaaaaaagcacctatatattttggggaatccaggaagtcacatgcatgcgcaggactgggtgtgtgctcagaaaagacctgttaagaccataagctttctcaagaactctgtctaatctctaggctcagtgaaggcagtcaactcagaaagagttgtaaacagcgtttaaaaagtaccccaacacagagtcaatccacaaagactgggagaagtgttttgtgttggtttttctcttgataaaatctctgtcaaaacactggttgaacacaagctaaagaaaaagacttcagtgactgtactcgacaaagaatagtctttgcaaaaatagtttggaaaagtcactaaatgaacatgtgactctagtcttcaacaatcaaaaacagcaaagcctggaggggggataccacattttaatattcagttgtgcagtttttaacaaagcaaaaatcatgaagcatataacgaagcaaaaaaatatgtcccattcaaaggaaaaaagtaaactgacaaaaagtgtcctggagaaagcacagacattggacttaagtagacaaaaacttcaaatcaactgcctcaaatatgctcagagaggtgaaagaaaccatagagaactaggctgggcatggtggctcacacctgtaacccagcaccacggtggctcacacctgtaacccagcaccacggtggctcacgcctgtaacccagcaccacggtggctcacgcctgtaacccagcaccacggtggctcacgcctgtaacccagcaccacggtggctcatgcctgtcatcccagcactttgggaggctgaggcaggtggatcacgaggtcaggagatcaagaccatcctggctaacaaggtgaaaccccatctcaactaaaaatacaaaaaattagctgggcatggtggcaggcacctgtagtcccagctactctgaagactgaggcaagagaatggcatgaacccaggaggcggagcttgcagtgagctgagatcacaccactgcactccagcgtgggtgacagagtgagactccgtctcaagaaaaaaaaaaagaaaaaaagaaaaaaaaaaaccatagagaactaaaagaaccaggaaaatgatgtgtgaacaaaatgaaaatatcaataagaaatacaaattgtaaaagaaacatagaaagtctggaactaaaaaatgaaatggaaattttgctagagggtttcagcagtagatttgagcaggcagaaaaatcggcaacttgaagataggataattgaaatcattcagtctgaggagaaaaaagatctaagaaaagtgaacttaatggctgggcgttgtggctcacgcctgtcatcccagcactttgggaggccgaggcaagcagatcacttgaggtcaggagatcgagagaatcttggccaacgtggtgaaaccctgtctctactaaaactacaaaaatcagctaggcgtggtgatgcatgcctgtagtcccagctactctggaggctgaggcaggagaatcgcttgaacccaggaggcggaggttgcattgagccgaaatcgtgccactgtactccagcctgggtaatggagtgagactctgtctcaaaaaaaaaagaaaaaagaaaagtgaacttaatggaccatgagacaccatcaagtagaccaacgtgcatagtagggatgttcaagaaggaaaagaatagagaaggggatggaaaaaatatttgaagaaataatggctgagagtatccccaatgtgatgaaagacatgtctacacacacaagcagttcaacaaactgagtagagtctatttaaagagatccacaccaggtctctttctaatcaaattgttgaaatacaaggaatcttgaaagcagcaagagaggagacctatccctgaacaaggggttctgggtaagatttctagccagtttttcatcagaacccatggaggtcagaaggcagtgggacggcttagttaaactgctaagagggggaaaaaaacctgtcaactaagaattctgttatctggcaaaattattcttcaaaatgaaggagaaattaaaacatatccaggtagataaaagctgaggaagcttgttacaaatagactgccccacaaggaatgcttttaaagggagtcctgaaggttgaaatgaaagaacactagacagggactcaaagccatacaaaaataaagacctccagtaaaagtaactacataggtaagtataaaagttagtatccctatattttggtttctaagtacactttgtattaagttggtgcaaaattaattgtggtttttgccattacatatttcctaagtgatctaaagaacaaatgcataaaaggtctgcattataagtctatgttttttaccccactatgtataaaggtgtaatctgtgatgacaacaacataaggggggtaacatctgtagagaagcagagattttgtgttactgagactaaactggtatcagttgttttaggatgttagaacgttcattgcaatcatcatggtaatcagtaagaaaatatcttaaaaatgggcttgacgcagtggctcacacctgtaatcccagcactttgggaggccaaggcaggcagatcacctgaggtcaggagttcgagaccagcctggccaacatggtgaaaccctgtctctactaaaaatacaaaaattagctgggcatggtggtgggcacctgtaatcccagctactcaggaggctgaagcaggagaattgcttgaacccaggaggcagaggttgaactcaggcagaggcatgagattgtgccactgcattccagcctgggtgacagagcaaaactccacttcaaaaaaaaatcttaaaaatgggccaggcatggtggctcatgcctgtaatcccagcactttgggaggccgaggcgggcagatcacaaggtcaggagattgagaccatcccggctaacacagtgaaaccccgtctctactaaaaatacaaaaaaattagccaggcaaggtggtgggcacctgtagtcccagctacttgggaggctgaggcaggagaatggcgtgaacccgggagacggagcttgcaatgagccaagatcgcgccactgcactccagcctgggagacagagcgagactccctctcaaaaaaaaaaaaaaaaaaatcttaaaaatggacacaagaggccaggcgcggtggctcacgcctgtaatcccagcactttgggggctgaggtgggcagatcatgaggtcaggagattgagaccatcctggccaacacagtgaaaccccatctctactaaaaatacaaaaaattagccgggcacgatggcacccgcctgtagtcccagctacttgggaggctgaggcaggagaatcccttgaacctgggaggcagaggttgcagtaagctgagaccatgccactgcactccagcctgggtgacagcgagactgtctcaaaaaaaaaaaaatggacacaagaagtaaggcaagaattaaaatggtacactacaaaaaaggtaatacctaagaatacagcagtagaggaactgaggaacaaaaaggtaaaagatttatcaaaaataaataaaatggcagaagtccttccttttcagtaattacatgtgaagtctccagtcaaaaggcaaatattgacagaatgtgtaagaaaacatggtccaactatatgccacaagaggctttagattcaaagacacaataagtttaaagtgaaaggtggaaaaatattccatgcagagaataaccaaaagagagttggggtgactataccaatattagacaaaatagatgacaaataaggacagtatgtatttataaaagggcagagtcatcaagaagatatggcaattataagcagatacacatcaaaaaaaagagctccaaactatctgaaacagacatagacagattggaagggagaaatagctctatagtaatagagacttcagtactccactttgaaaaatggatagaacatctagacagaagatcactaaggaactaggggatttgaacagcgttacaacccaactagacctaatggacgaccatcactgtggtctaaatgtcccccccaacccctcccctctccagtcatatcttgaaatctaatctgcagtgtgtcgttattaagaggtggggcctttgggaggtgactgggccatgagagcagagccctgtgaatgggattatctccttataagaggcctgagggagcttgttagcttcttttcttgcccttctaccatgtgaatacacatagaagggaatacctaggaggaaccagctctcatcaggcagtgaatccactggcaccttgatcttgaacttcccagcctccagaactgtgagcaataaatttctgttgtttataaattacccagtctaatgtatcttgttacagtagcccaaatgggctaagacagaagtatataaaatactccattcagaaaagaagatatacattcttctcaagtgtacatgtaacacaaaccatatgttagaccacaaaacaagtctcaataaatttaaaaagattggaattacacaaagtatcttctctgaccagcaacagcggggaaactggaaagtttacaaatgtatagaaataaaacaaccaatggatcaaagatgaaatcagacagttagacaatacctgcagatgaatgaaaacacaacataccaaaacttatgggatgcagtgaaggcaatgtcaaaagggaaatttatagcaataaacacccttgttgaaaaggaagagagaggccaggtgtgattgggaggctgaggtgggtggatcgcttaagcccaggagttcgagaccagcctgggcaacatggttgagaccccatctctactaagaatacagaaaattagctgggcgtggttgcttgtgcttgtagtcctagttacttgggaggctgagataggaagatcacctaagcttaggaagttgaggctgcagtgagctgagatcatgccactgcattccagcctgagcaatgagagtgagaccctgtctcaaaaaaaaaggaaagaaagatataagtcagatttaaaagtataaatcttttaaaggactataaaagaagagcaaataaaatccaaagctagcagcaggaagaaaaaagaaggattagaacagtgttaaatgaaatagagtagaaaatagaatcaacaaaatcaaacgttgcttttgtgaaaagataaagttgataaacctttacttagattgattaaataaaaaagacacaaataactaaaatcagaagtggaagtgggaacattactagtgaccttacaaaaataaaaagagaatattgtgactaattgtacaccaacaaattagataacccagatgaaagggacaaatcaatagaaacacacaaattcctaaaactgactcaagcataggtagaaaatcagaacagacctctaacagagattgagttagtaataaaaactcccaataaaataaagtccaggaccacaatggcttttttttttttttttttttttttttgagacggagtctcgctctgttcctcaggctggagtgcagtggcacaatctgagttcactgtgacctctgcctcctgggttcaagcaattctcctgtctcagcctcctgagtagctgggactacaggcacgtgccactatgcccagctaattttttgtatttttagtagagaccgtgttccccaggctggtctcaaactcctgagctcaggcaatccacccgcctcggcctcccagagtgctaggattacagactgagcaaccgtgcctggcccacaatggatttaaaggtgaatttaatgaattaataccaaaccttcgcaaactcttgcaaaggaggagagaacactttctaattctacaaggtcaactttacactgattccaaagccagataaagatatggcttgaagacaagaaaagaaaattacaaaccaatatcctttatggctagagatataaaactcccaacaaagaaatagaaaactgaatccaatagcatatgaccaagtgggatttaacccaggatataagggtggttcaacataagaaaacctagtgttgtaattcatcacattaatagaacgaaggagaaaaactatgatcatctcaatttatgcaaataaaacatttggcaaaatctaacactttcacagttaaaaaaaaaaagcattcataaaacttgtaatagaagaggacctcctgaacatgataaagggcatttgtgaaaaccctcaagctgacatcatacacagtagtgaagaacaaaactcttcccctaaggtcagtaacaagacaaacatgccactctgcagccttgtattgcaagttctaaccagagcagttagtcaagaaaaagaaataaaagacatccagttgggaaatgaagtaaaattctttttccataagatgtgaatccgtatatatgaaatcccagagaatccacaaaaaagctattagaggtaataaacaaacccagcaaagttgcagcaactgatcaacacacaaaatcagttgtttctgtataccagccatgaacagtgtgaaaaggaaattaaggaaggaattccatatacaatagcatcaatagggaaaattaaaacctaggactaaatttgaccaaggagatttaagacttgtccactgaaaactgcaaaatattgtggaaaggaattaaagaaatcacaaataaatagaaggcatcatgtgttcatgaattggaagacaatattaatcatccaaactacctagagtgttctacagattcaatgccattcctatcaaaattacaatggccattttttgcagaaacaaaagacgatcctcaaattcatatgaagttacaaagagccctgggtagccaaaacaatcatgaaaaataacgtcagaggacttagactttccactttcaaaacttgctacaaagctgcagtaatcaaaacaatgtggtactggcacaaagacatacagactagtggaatcagattgagagtccagaaataaacgcatacatatgtggcaggtggattttcaacaagggtaccaagtcctttcaatcaatgagaaaagatagcccttctgcaaatggtgctgagacaagtagatatccaaatgtaaaagaatgaagttggggccggatgtggtggctcatgcctgtaatcccagcactttgggagtccaaggtgagaggatcgcttgaggccaggagtttgagaccagcatgggcaacatagcaagactctgtctctacaaaaaaatacaaaaaaaaaatagccagttgtgttggtgcctactccaggggtgctgaggcaggaggatcacttgagcccaacagctcaaggctacagtcagctgtgatcaccactgcactccagcttgaatagcaaagcaagaccctgtcccaaaaaatgagtgaaggtgaacccctaccttatgccatatacaaaaattaactccaaatagatcaacaagctaaatataagagctaacaactctaaaattcttagaagaaagtgtaggggtaaatcttcccaatcttggatttggcagtggattcctagatatggcaccaaagcatgagcaacaaaagaaaaaaataaataaattggacttcatcaaaatttaaaacttgaatatcaaaatatattatcaagaacgtgaaaagaagccaggtgtggtggctcagcctgttacccagcattttgggaggccaaggcaggcagatcacctgatgtcaggagtttgagaccagcctggccaatatggcgaaaccccatctctactaaaactacaaaaattagctgggcatggtggcatgtgcccgtagttccagctactctggaggcttttgcttgaacccaggaggcagaggttgcagtgagccaagatcgcaccagtgtactccagcctggatgacagagcaagactctgtctcaaaaaaaaaaaaaaaaaaaaagagagagaaagaaagtgaaaaaagcatcctgcagaatggggggaaatctgcaaatcatattttttataagggtgtagtatgtagaatatataaagaagtcttacttctcaacaacaaaacacaagcaacccaatttaaaaatgggcaaaggctgggcacggtggctcacaactgcaatcccagaactttgggaggccaaggcaggtggatcacttgaggtcaggagtttaagaccatgctggccaacgtgatgaaaccctgtctctactaaaaatacaaaacttagctgggagtggtggcatgcacctgtaatcccagctactcaggaggcggaggttgcagtgagccgagatcatgccactgcactccagcctgggtgacagagcaagactctgtctcataaataaataaataaataaataaataaggggcaaagaacttgaataaacatttctccaaagaaaacatatgaatggctaacaagcaaaagaaaagatgcttaacatcattagtcattagagaaatgcaaatcaaaaccataatgagattactatttcacattcattaggatgtctataatcaaaaaaacaaaagataaaagaggatgtggagaaactggtatcctcatacatcgctggctggaatgtaaaatggcataactactctgaaaaataatttggtggttcctcaaaagtttgaacatagtactactcctagatatatactcaagataattgaagacacatactcaaacaagtacatgcatatcatgttcacagcagtagtattcatgatagccaaaaggtacaaacagcccagatgtctgtcaatggatgaatgattaattgtggtgtctacatacaaatgaatataatttagccatgaaaaggaagcactgtacctgctacacgcggataaacctctgagatgtgccgagtgaaagaagccagacacaaaaggtcacatactatataattccatttgtacaaaatatccagaataggtaaattcgtagacacagaatacagattagtggttgccagggcctggagggagaggaagatggggataaactgcttaatgggtaagaggttttactttggagtgatgggaatgttttgaaaatagaggtggtggttgcataacattatagatgtactaaatgccgctgttcgttttagaatgattttatgttatgttaatttcacctcagtaaatgtttaaatcaaatgaaaacaacttgctgtaggagatgaagaagtaaggagcaccccatctgagtgtgagatgcctctggggtttgtccaacacacagcccagccgaggctctgagggaggtcgtggtgcagccactgatgcatcacagccacacgtggcattcacacaagcatggtttatgacttgggtaattatccaagctgttccacaaacctggaggtcactcatcgtaaaagtctttaatcataaagatgtgtttcctcttcacagaaggtgtgttttgttctggaagggctcagagtccttgtccttttttccaattgggtgtcagagtacagtgcaagcaactgtatttgctttcaaatctttttcttcacctttaagcccaaattttactgactttttaaaaagatgttctttggccgggcatggtggctcacacctgtaatcccagcagtctgggaggccgaggcgggtagatcacctgaggtcaggagttcgagaccagcctgaccaacacagagaaaccctgtctctactaaaaatacaacaaaatttagcagggcatggtggcacatccctgtaatcccagctactcgggaggctgaggtaggagaatcacttgaacccaggaggcagaggttgtggtgagctgagatggcaccgttgcactcgagcctgggctataagagccaaactctgtctccaaaaaaaaatttttcttaaaggaaaataaaattttttattttatatttcctttctgtagaggaactcattttttccccacaattcttatattacagagaagaattacattgaatttaatcagtccaaaaagtgatctctcacccttctcacgtacagaattcacctttagttcctgtctcaataaaagactttgatctatctaaacagtggctcgggctagacaacccgttcctcatggtcgccatctcttcatccacaccagtgacatctcatctcagccagaggtcaccaaatccagctagtgggctggtttttatgtcctgcaagctaagaatgcttttgaggtgttttttaagggttttaaaaacaacaaagaagaccatatgacagagatcatacagccgtaatgtatgtatgatcctcctctctgacccttcacagaagtaccttcctgactcctgtctgtgttgttgccagagccttcttcatccttccttgggtcacttctccacacagccagaagagggcaacggtctcccaagtcagggtcttggcaggggtggaggatgggggacagcgagtcccaggacatctctgtcagggctgaagacttctgttcagacctcacctgtcccagcagcccccattcctcattgctcctgggagcccagcagcatgtagatgccacatttcccagacaccctctggagccagggctggggcttctgacatggagagctgaagctcatgggggacattggggaatcccctgcagcccatgtggagtgtataacagcaggcctgccaaagggcagcagggtggtaaagaaaggcacccacatctgtgtgctggcacgtagggcagctctgtgggagaggagaggcctgatcccagactccaggaagtagggagctgcaagagggtgttctggctgaaagtggcacagcacgatgtgtctgcaccacaggtgtccagtgacccaacatgaagtgtcaccaagagacacgtgggtgcagtgggtagaggggcaagtcccaggagggtcatggtgagagctgggccggtttggatctttgttgacaccacagctccttgggaacagacaattccagactggaggtggaaatggaatgctgttatggcagattctggaagtcccagacagggagaggcagggagggagcagagtggacgccgcaaggtgggaggggcattggaggggcatccttcacacccactcagcactaccgactacagctagaccagaggtcttccactttgggggatgcagtcctgtttcagggagtgatccaggctgtgggtgacagccagggtgggggcaaggaaagtaggtggggtgctggcatttatgatcagggaagggctctccagcaaggcctgtgcaagggaagtgggtagcacgagggccatgtggagagtgctctgggcaaggcagacccaaaggtggacacatctgccctgctcagagtatagcaggagcagaggtagaggtggggtctaggagggccaggaggcactgagaggatgtttgagtgcatgacagtgctgggtctgatgtcaccaggctgtgggcaggaggggaggttgggggccagggaagctgctcagcatccaggtggcagtgtggcctgggatgtcagtttgaatgagagactcgtgacatcttcatttgagtaagggacacagggacatgagggtttctttgttctgcaggtgtgaaaaggggagagggagatgctgaagccttttctggcagacacggagctttgtgtgcatttctgtctgcggaaagatgacgcacattgttacgaggccagaagtcatccgcaaacaccagtcagaattgtgggttttcagaggtacaggtggctttgacaggacacagcagtctctaaagggtcctctgttgaacaggatggaatctgatgttccacacaggtccctgccgcacaggagtggttgaatgatgcctccatgcaactcaacttgccaggccctgagagccagctgggtttcttctctgtgtacaacggggtctctctccacactagtgactcctaagaccaagctcagtgccattagcatgcactgacagaactggagataggctggtaaggctcacacctggcagtgtggacagaaaaaagggtgaaatatgtaacagtgtaaggagtggtgtgagacgtttttctggtacaggtgggagaagtgagaagcacctggatttgggctgcactctgaggtagagctgacaggacttgccagtggtttggtgtgggtgtcgaggaagaggggagtcaagggacagccaggattttggcctgagccagaaggtagaccgcagtaacgtttgctgagatgtggagtcccagggagggtgggtccgtggtcatcaagagctctcactcatctgcagccccatgcagcctaatcacccagtgctcctcccacccctccctgatgccctctgatctggactgccaccccagaggatcccctgctccccttgcctcctccacagttagtgggtgcaactgtgactgtctatgttcctgctcctgctgcagcactgccttccaagtgatattctatttattgtttcagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggtaatgagttgtgtggcgtgaattctttgtcactggctgtaattgatattttaggtaagtcgagagtttttcaggtccagttgctctgtcatcttccccagaagtggtacctactcatcaccaccaattccctgcccttctttgtccctcctgttccagaatttgaacccaaggctcccccgccaccctacttttctttatacagatctgcaatctgaggtcagctttctcctctcactggtctgctgtgacttaggcccccatatcctgttctgggctgctgcacagttccacatggctgttccagcttctagtttctgggccacagaggaagctctctccatggacctcattttcatgcccatgagcttccaggctgttttttccacctagtaagtgccctgccttgagggcctagctcacttacccccatccttagttctcagagctgtgctcctgttccctgagcaaggagaaagcccagatgctgagaggcccctccctgctggccagcaggtctgggggtgtcaggacacagtttcatggaaaacctagccctgacctgttttagataaaagttttgttggaacacagctatgcccatttgtttacagatagctgtggcagcttttgtaccacagaattgagcagttgtgatagatcccatatggtgcacaaagccaaagtatttacttctggtccttgataggaaagtttgctgaccctgccttaggatgctccctgtgacctaagttgcctcttgggactcaagagttcttgcaggagttaaagtgtgttttgtgaccaagggactattctgtactgtggagtggttggctgtgtgcaggtgggtgattgctgcagagttcccacagccacagagcatccatcctctttaccactccccaacacacagtacgccctctggagagatgcaagacctaagtgttgactgagttcttactgcagttaagagttttgtgaagattgaataaaatggtatgtgtaagtgttttattttatttttttgagacggagtttcgctatgtcacccaggctggagtgcaatggcgcgatctcagctcactgcaacctccaccttccgggttcgagtgattctcctgcctcagcctcccaagtagctgggactgcaggcgcccaccaccacacccaactactttttgtatttttagtagagacaggatttcaccatgttggccaggctggtctcaatctcttgacctcgtgatccacccgcctcagccttgcaaagtgctgggattacaggtgtgagctgccatgccgggccatgtaaagtatttttaactgtacctagtccttggcaatctctgctaggcattactaacattaaccaaaaattagtatctcacagaaacactaagagagctgatgaaatagactggagtccgagattccaggaaagaatccagaatcatcccatggagctcccctgccaagggaactgctgactacttaggaatcccacggctctgctgtgacctaggtgagcatgcggaagtccaattttcctatttaactctgctttaagtcttgtgcagacagatctgagcacttgaaccaattcttattctccactagcagcaagggaggccaggaagtgtagatggtggcttctgtgttggaaaggctgcagagagcttctaaaacatgaggttctatgagattttgaatagtcataaatgatatatgtccactataagctacgtttttgtagtttttaaattgtgaaataatttcccacacaaaagtattatgagtaccgtaaagaacacccaaatatctttactcaaattcccgttagcattttgccacgtttgccatatcatcttcttctccctcgcagtagataactttggccctgagactaagttgcagatgtgatgcaccttacccctaaatacatcagcatgtgcttcctaagaacaagggtgttctctttcatgaccacagtattcgctggaaaatg

SEQ ID NO: 14499 - DNA, 11276 bp, Human
  misc_feature (1)...(11276): n = A,T,C or G
ttggttttgggagttggcgtactttgggaaagcttaaacaaactgtgccttaatacagaatttgtgataatttagacttggtgtatgtattgagtaaaaagtttacactctctttctctgtgaattttcagggtcttataggggaaatcaataacttcttttaatcaaagggttcaagaaattaaggatcccttcaccttctgggcctggcacttcttgtatgttatgtgtgtggtgttctgtgatgtgggctatcgtgtactgtattttttttttacattaacttagctcattttccttatcagtgcgtatctgtatcttaagttatgatctgtggttctgcatctccgtcagacacatgctttcttcacggggtcgtctgtaggccacgcctccctagtcagctgggaagggggagagggtctggtccacctgccccagcggtacaagtggaaggtggggcccagagttgctagtgactcatccctggagacggaggcagccctggggccactgctgccccaccctgtgtgtgcacgccgctcagtggtggacaaggacacggagttttgaggagaccgagctagtgtgggtgccgacctttgagtcaccacctaagaggtgacctctcccacatccgttctgcagcttggtaacaatgaagctgccgccaaccagagccccgccgcagttgacacgggagggaaggggatgggaaggcagggaccgcagacagctttcccgagctggggcaggtgtgactgcgagaggctcccaggcccgcctgatgccgctttccctttttggcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggcttccggtgtccccgagtggtcggcgcgggctccccgggctcaggtctgccgcctggcagctcggtcgtggcttaaaactcccttggttggacaggggacaactgtagattattgtgccaaaaaataagaaaaaaaactcccctggttgggacagcgccccgtggaggttcccggaggtggcggcggtgggacggtccccacgccgcactgccccgccagccgagcgccaggtgtgggcggtgcggagaggccaggtgtgggtcggggggcggggctcggaaagcgcggcacacgccattggctgtgcgtttggagggggcgggactctgtcaggggctcacgccattggccgtgcgcggaggtgcggtggggcgcggccttcggggggtggggctcggggcggagggcgggaggcggggcgggggaagcgggggctgggctcgggccgagcgccgacccattggccgtgcgcagcgggtgaggcccgcgtgacggccgctgagcgtgcgctggcggggcgggcggcggcgctcggagtcgccgggagctgccaggctgctccgcgcgccgctgcggggccatgatccggaacgggcgcggggctgcaggcggcgcagagcagccgggcccggggggcaggcgcgccgtgagggtgtggtgcgatggctggtgagcgcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtaggtgggcatcgggtgcgacctgcctgtccgggacccgcggtgaagcccgcgggctcccgggtcctcctccgcggggctagaatgcgatcggtcttccctggccagtcagagggcattgttttaagaaaagtttcgggttgtcaacaagtgaaaggaagacgaccgttactgataatttgctacctctgaccctttcacgtgcctgccggatggaatccaggaagcaagcgcctctatctgattagcccttcccaggagagcaagcagggccttgtcttctgtgtccgagtcacctctgggaaaaggaatgtggctttgtgtcagtggactttgaccttgccctgaccaggccccagccccattccagactgtgctcccctggcccagcctctgccccctcctcccctccagcctgtccagtgggtacatgggcccgccagattttacccagcatgtctgccgggctccgcgcactgtggcaggggtgctgggaggaagcagtggtgtgcagtggagcaactctgtgcactgtgtgggctgccagggtcacacctctccctggagaggcagggacagctttgtccacttgaggggatgggccgctgctgtaaagaagtggcgaagaagccagggcagcgaggcccagttggtggcagggctgtgtagctttgggcttgagagttcacgtgttagcagacctagatttgtgaatgaaaactctcgagccaggtggcaaggcagtggctgttcacccttagcgttaagcctgctgagcttgaggccgtaagggaggagagacaggattttcagggccagtgattcccagggttttattttgtggttggatttgttttgggttagccccagggactgtttgcttgtctcaaggtagtctaggatccaaccctaccccaagagttaacatcggcttattttaaagtgactgcccagggcagttgatatttggtgaggggataggacacgtggccctgcagctttcagtgggctccagtctgtcctgcacccaccagtcctctagacccagccaggccttgacatctctgcccctgccaccctttctagatctggcacaggggtcccaccgtcaggcccaggagccagtggggtggagagctgagcacctacatcctccgaatcccagtcccagggctcccagcagcagcttctcagagcgcttcctaaggagtcctcagaggagcaaagctctgcccctaacccacagggacacctggtccccacccttggcacagggaccacccactctctctgtctccacagctatgacatggtgcattacggccactccaaccagctgcgccaggcacgggccatgggtgactacctcatcgtaggcgtgcacaccgatggtaagcacagatggcctcgcccacccgcggccccccagccctcctgtgggttgcgactgttgactgaaagcctgcaggcctggggccaccttgccagggcacagctgtaggggagggcactgtaggctcacccagcccagccccagctgaggatggcctaatgcctttcccatcttgcatttcctgtcccagctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccagggtagagagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcagtgagtggcggggctgggacctgggggcctggggacatcaggtggctcaggatcagatctgctggtgggacatccgggaacagggggcctccgccctttgaggatctgagacatttccgggcccccacctagaaatgggcacgcggacactagggcaggccaggggccgagagggtcctgggctctgaaggttctggtggctttgggttaaggatccttgtccttgtgtgtcactgcttagatgacatcaccctgactgtagatggccgggacacctatgaggaagtaaagcaggctgggaggtacaggtgagtctccaccgcgggcctggccatccagggagctggacacggggctccctcctggctcgtgctttgctatttaccgggagcccgtgaggggagcgtccaggccctgggccatgttcctcacgcccaggactgggaactcgagggatggaggtgccattgtggggtggcctggaggcccttgccatttggtgctgcagacccatggccccagggctccaaaggcacagctttgtgaggtggcagctgttgagctcgggggacgtggctggcactgctggggagctggcactatatctgaattaccagacgtcagggacatgaggccagtggctcccgcatgagatgctgcagctgagaattcactcagctgcagatgctcagcgggcaggacgtgggtgtgagggaggcaggaagcagagctgctaccccagtgcccatcctctccctggcattgcacacctgggccccagcaagggtccttttctgtgctcctgccactcccttcagtcaataaaagcgtggaggccttccccatgttcccaacccaggttttctgttatggccttgcacaggaaggggaccctcagtctttggggcagccgtgggttctgccacagcagggctgctagtgtccctagtggtggtagcaggaggcagagccttgcgagtgtcccaggatgagaccccactcccactgtgtcccccagagaatgcaagcgcacgcaaggggtgtccaccacagacctcgtgggccgcatgctgctggtaaccaaagcccatcacagcagccaggtgagtcggcggcggaatccccgaggcccctgggtcgaggtctccaggggaaaggaggggcacctccctgccctctcagggtcctcctgcccactgctccccatccccagccggttctggggtggccacgccgggagggcaggcccctcagccctgctctgaccttctgtgcaggagatgtcctctgagtaccgggagtatgcagacagttttggcaaggtgagtgcggctgtgcagggagagctgagcacgcagctgcagggggctcccccggccacctgtcccagccatcccttggggaaaggccagcccagagcctcaccctcctccctctgtccctggcactgaccaggcactgactgccaggtttggctcactggtggatgctgggagggagggcaggcgggtggtggcaccggctggccggtcacggcagccactgcttggaggagcaaggatttgcctgtggacaggtggcctctaaccaagtggcctggccctctctcccattgtagccccctcacccgatacccgccggggacatactttcctcagaaggctgctcccaggtgaccagacagtggtctcagggtaccaggtccctcccaagggctgtgtgcacctgccacagggctccttgcctcctcctggtggtcgcttgctgggctgaagtggtgtctgctgcggtgcctgctgtggttgtggggtggcgccacagtcccacctgccacctggcctggcagtgtgtcccctgcccgagatgactggctggaaatgggattgctggcaggtgacagctgagggtttggtgacctggtgagggcagcacctgggaggcctcccccgccaacctgctccctctcttggcttgcagtgccctggtgggcggaacccctggaccggggtatcccagttcctgcagacatctcagaagatcatccagtttgcttctgggaaggagccccagccaggggagacagtcatctatgtggctggtgccttcgacctgttccgtatcctctgggcctctgctgctcccctacatgtgccacatggggtgggacccgggggcctcacttgactccttggggcccccagactgggctggctggtttgcaggggagcagctgtcagcagggaggatggcggggaggcccttgggcatgagctgtcagggagctgctccctgtcatccccatcccgactgcttcttaacctgggtgcagacatcgggcatgtggacttcctggagaaggtgcacaggctggcagagaggccctacatcatcgcgggcttacactttgaccaggtcactgccttcttgctccctgggcccctgggcagctgatgggccctcgaggggccctaagcgttgctgttaggtgcaggtggtctctgggaaggggccccaggtgaagtcacaggagaccctggggggtgatcgtaggcttctggggtccagggctgtcctgtctggggcatccccacaagggcgagcaacctccccgacttcttcccatgagggacagccgggaggggcacaccctgtccccccaaaaagtctccgggctgagctagccgcactctggccgcaggaggtcaatcactacaaggggaagaactaccccatcatgaatctgcatgaacggactctgagcgtgctggcctgccgggtgagtgggggccaggagccagcccaaggatggggagacattcccacaacatcccccctactaagggcctccctgagccagggcaggggggcttgggtcactggcagagctgcacccagcaccccgagttctgtggcacctgcccatacctgtttgttgaggcatgaggaggggtggtcaggtctccagatgctgttccttcttgtctcatggaggagccccaggggtccccagcctgcccagcccatccctgctactcactggcagccccgccccatgtctgagccgtctctcaccaccctgtggccctggcttaccagtagcagggaccgagcaagtctttctgcccccactgtccccacagtacgtgtcagaagtggtgattggagccccgtacgcggtcacagcagagctcctaagtcacttcaaggtgaggctccgcatgggctcacctcgttccctctgttcacctctgttcctgcatgggctgggaatgcaggctggctgtgggctcctaggcggggcccaggaggtacctgggctgaggaaagggcagggtcagctctcccaacccccggggcctgtgctgggctgtgggtggcgacggccgctgcctccccggggagggctcctgaccccactccttctccaggtggacctggtgtgtcacggcaagacagaaattatccctgacagggatggctccgacccataccaggtgggtcatgctggcccttgctgggcacaggggttgccattggcacctcccagccatttaatgactcactgtgcctgcctgggaaacgggcatggtggcgcagctgctccgactgcaccactcccatgggaccctgggcgctggtctccctctggggcagggcatcagatgggtcttggggaggtcagcagggaccttcatcccgctcctcctctctggacccccaggagcccaagagaaggggcatcttccgtcagattgacagtggcagcaacctcaccacagacctcatcgtccagcggatcatcaccaacaggtgcagttgggtgggggcacctcggagccgcctcatgggcgctctccgctagacttaccctgccctccccctcggagccgcctcatgggcgctctctgctagacttaccctgccctctcaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctcactccgaggccgcctcatttatttattcgtttgccattaactgcggggtgagcggagtaggggagacctggggcgccatcccgcgccggaggggcctggggtcaccgagtgggacggtgggggcggggggcccccagcggtgccaggagaggtccgggctcaggcggcgaggcagtcggctgcgcgcagggacaggaagacgttcgccttgcactggtaggtcccgcggccgtcggggagccgctcgcacctctgcaggtttggggcgacgtcctggacgcacacagcctggggggcaggcaagcaaaggctgaggggccgccgcacccccacccacgtcctgccgccgccccccatcagtccccggcacgccggactcacgaggctccgcagcctggggtgcagttgcagctccggggaggcgccggccccgcccgggggttccgcccctctgtagggctgggagcgccgcgcgtacggggacctgcggaggccggacagcagccccgcggcgcggcccaccgagtaggagctgtgccccgccgctggcttgtaccacgcgaggccaggcggcgccagcagcaggcacagcgccagggcggcggccgccagtgtcgcggaccgggccatggggacgccggctgactggtgggcggcggcgtccgggctcggagcagccaccgcctgggccgcc

SEQ ID NO: 14500 - DNA, 10223 bp, Human
  misc_feature (1)...(10223): n = A,T,C or G
agtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcatgtggcctggccccccgggtatttattgctgtacatagtgtatgtttgtgatatataaggttttctttattttgtatatgatcaataaaccttttaaagagactggcaggtgcttctttggggcgacgcggcgggcggagccggaaggggtgggtgggggcggggcccatcttgcgcatgcgccctgagcgcggcctgccgtgtgaggcggaagcggaagagcaggtctccaggggagcgatggcagccgggggtctgagccgctccgagcgcaaagcgcggagcgggtccggaggttgcgggaggagcagcagagggagcgcctccgccaggtacgccgccgccgctccccggcccggccattgccggcccgcgccgccgctcaccgtccgcctgcccgcaggtgtcgcgcatcctgaggaaggcggcggcggagcgcagcgccgaggagggccggctgctggccgagagcgcggacctggtaacggagctgcaggccggaccggcggcgcgagggcctgaagcggcggcaggaggaggcgagttcccgcgtgcgcgcgcgggcgcccccggtttcgggagcagctggggcgacgggcggtcccgggtggggcggcccggggcggtgaccaccctggcgtcttggcaggtgtgcgacgacccggaggagctgcgggggaaggtccgggagctggccagcgccgtccggaacgccaaatacttggtcgtctacacaggcgcgggaatcagcacggtagggagggaggcggaggcgtaccccaggacggagtatgagctccagtaatcgcgaaaaactcgcctttaaagcagctctaaggttttttctcttaaagaaacgaaatgaccaaaacttacctaaggtaaacgctttttaaacgcttggcctctgtgttacagccagttaaaaaaaacaaggagtagagatacgaatggggtgtagtagccgactgctcgcaggcacccccaggttatgtggacagagctaagcccaaagttgtgattttccactctgttctgtccatgtcgagggaagataagtagaaagtgacacagtaagagccagaatacaccaggtgaaggagagaattgcattgtgttttgagaagtttcactgacaagttatcctgggctgtgggacatcactagctttgaaagtgtagctggcacctcgtccatctaatttgatgggtgtgtgtggggtgttgggcacgcgtcggcctagcagatctgaacccaggtgatttctgttctcaggaagcttttaggtgacaaggatcaggcatgtgaacaaataaccatactgtaaagctggctgtgctgggtcgctagagcaaactcagacacacactctgcgctcttggagttgggaaacccacctgcgttggctttttgtgggaggtggccttgattgggccttgaaggatgggtgagatttacagaaggttggaatgaggcactccaagcaaagaacagcagaggctcagcagcaagaatgcaaaaagggagttcactactgactcaaatacccggagccctggggtttagtctcctccctccacaagtcacatgtaaaagtccagtcatgctgggcgcggtggctcatgcctataatcctagcactttgggaggccgaggtgggcggatcatgaggtcagtagttcaagaacaacctggccaacacggtgaaaccctgtctctactaaaaatacaaaaattagtcgggcatggtggtgggcacctgcaatcccagctactcgagaggctgaggcaggagaatcacttgaaactggaaggcggaggttgcagtgagccgagatcatgccactgcattccagcctgggcgaaagagctaaactccgtctctcaaaaaaaaaaaaaaaaaaaaaagtccagtcatgtaattatgtaacagtcacgtgacctgttatggaacttccaatggcaactaaaagcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttaggtaagcgggccaggcatggcctcccacataggctgggcagcggcagcacgggcctgagctccagctctcctcaccttgccttcctttctgcctggcagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttccaggtgcagcatgtggtgtctcagaactgtgacgggctccacctgaggagtgggctgccgcgcacggccatctccgagctccacgggaacatgtacattgaagtgagcagtcctgcagggacccagggtctccatgggcaggcgggtcccactcactgtgccctcttgcctctaggtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggtacgtgccgatgacacaatgagtgaaccgagcccctgcccgcccgagggtgtccagctctgcggcccagcactgtacagacttgtcccttgtgtgtgtgcggtgtctgtctgtctgcttccacaggttctaaagaagtacccacgcctctggtgcatgaccaagccccctagccggcggccgaagctttacatcgtgaacctgcaggtaactcgggtgctgagagccacgtccttagatctgggtcttagaacgcacagccagagacaccccacacccatgcaccagggcggtctgatagggcccccgtgggtgctcagggagcaccgactgagcccgtaggggccaaggctgacaggccaccgggaagggttgggctgctgttactctcactcggctttccctgtcctcagtggaccccgaaggatgactgggctgccctgaagctacatgggaagtgtgatgacgtcatgcggctcctcatggccgagctgggcttggagatccccgcctatagcaggtgagtgagccgctgcagcagcctgcttccccgcacctctgtgtgctgggccttgtctgtcttctctcgtgagctgagtgtggaggaagctctgaggtgtttgcagtggtgcctgaggcatgactgaagcgtggtggtctccagagggcctgacctcggtggttggcggagaccctgcgtgtgccactcctgccctggctgatgtggcacacacaatccccgcggggagagggattctgcccgcgtgctcctgctccaggcctccccgtggagctctccgagatgcctggtgggaagcatctggaggggacgagcactcggcagctctggtcagacagaatctgtgtgcttggttttgggagttggcgtactttgggaaagcttaaacaaactgtgccttaatacagaatttgtgataatttagacttggtgtatgtattgagtaaaaagtttacactctctttctctgtgaattttcagggtcttataggggaaatcaataacttcttttaatcaaagggttcaagaaattaaggatcccttcaccttctgggcctggcacttcttgtatgttatgtgtgtggtgttctgtgatgtgggctatcgtgtactgtattttttttttacattaacttagctcattttccttatcagtgcgtatctgtatcttaagttatgatctgtggttctgcatctccgtcagacacatgctttcttcacggggtcgtctgtaggccacgcctccctagtcagctgggaagggggagagggtctggtccacctgccccagcggtacaagtggaaggtggggcccagagttgctagtgactcatccctggagacggaggcagccctggggccactgctgccccaccctgtgtgtgcacgccgctcagtggtggacaaggacacggagttttgaggagaccgagctagtgtgggtgccgacctttgagtcaccacctaagaggtgacctctcccacatccgttctgcagcttggtaacaatgaagctgccgccaaccagagccccgccgcagttgacacgggagggaaggggatgggaaggcagggaccgcagacagctttcccgagctggggcaggtgtgactgcgagaggctcccaggcccgcctgatgccgctttccctttttggcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggcttccggtgtccccgagtggtcggcgcgggctccccgggctcaggtctgccgcctggcagctcggtcgtggcttaaaactcccttggttggacaggggacaactgtagattattgtgccaaaaaataagaaaaaaaactcccctggttgggacagcgccccgtggaggttcccggaggtggcggcggtgggacggtccccacgccgcactgccccgccagccgagcgccaggtgtgggcggtgcggagaggccaggtgtgggtcggggggcggggctcggaaagcgcggcacacgccattggctgtgcgtttggagggggcgggactctgtcaggggctcacgccattggccgtgcgcggaggtgcggtggggcgcggccttcggggggtggggctcggggcggagggcgggaggcggggcgggggaagcgggggctgggctcgggccgagcgccgacccattggccgtgcgcagcgggtgaggcccgcgtgacggccgctgagcgtgcgctggcggggcgggcggcggcgctcggagtcgccgggagctgccaggctgctccgcgcgccgctgcggggccatgatccggaacgggcgcggggctgcaggcggcgcagagcagccgggcccggggggcaggcgcgccgtgagggtgtggtgcgatggctggtgagcgcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtaggtgggcatcgggtgcgacctgcctgtccgggacccgcggtgaagcccgcgggctcccgggtcctcctccgcggggctagaatgcgatcggtcttccctggccagtcagagggcattgttttaagaaaagtttcgggttgtcaacaagtgaaaggaagacgaccgttactgataatttgctacctctgaccctttcacgtgcctgccggatggaatccaggaagcaagcgcctctatctgattagcccttcccaggagagcaagcagggccttgtcttctgtgtccgagtcacctctgggaaaaggaatgtggctttgtgtcagtggactttgaccttgccctgaccaggccccagccccattccagactgtgctcccctggcccagcctctgccccctcctcccctccagcctgtccagtgggtacatgggcccgccagattttacccagcatgtctgccgggctccgcgcactgtggcaggggtgctgggaggaagcagtggtgtgcagtggagcaactctgtgcactgtgtgggctgccagggtcacacctctccctggagaggcagggacagctttgtccacttgaggggatgggccgctgctgtaaagaagtggcgaagaagccagggcagcgaggcccagttggtggcagggctgtgtagctttgggcttgagagttcacgtgttagcagacctagatttgtgaatgaaaactctcgagccaggtggcaaggcagtggctgttcacccttagcgttaagcctgctgagcttgaggccgtaagggaggagagacaggattttcagggccagtgattcccagggttttattttgtggttggatttgttttgggttagccccagggactgtttgcttgtctcaaggtagtctagg

SEQ ID NO: 14501 - DNA, 41988 bp, Human
  misc_feature (1)...(41988): n = A,T,C or G
catagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctcccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaagaattgattaaaatttactacaggaaataactgctttttagtgaagagaatggagtaatatagaagagttaaccaaactgcacaatgattgctagcattcaaatatgtggtagtgggcaagcttgtatagtcttccctggagtcctttaaatagactatgaaactgagtcttttcaggaggtatctgagcagtcagtgtcctaaaaatatcaaatgaccacaaatagattaaaagttatcgaagtttaagtacaaaacttaaatctggcaaataaagcttagctgattctattggctgcctttcacaattactttatgtactatttagtgtttcctcttcctcaagcctactaacatgaagtaaaacagaaatcgtttccaccagggggttagaaagtagataatagctacttagtaaagataatgttgatccattaaaatggagattttttttttttatactccagcagagagaaagaatggtgcctttaaaaggattctaatgattccgggtctagcatacttggaaagatttcaatgtaaataagcatttcatacataacagacggaatcttttgtttcctgaataacagaatcaagttatctactttgtcttagtcacaaattgctccctagtttgttaagatgcacactttatatatggtatgatgatcctgggttttgcattttgtgctaccaactagcctgcctagcttttagatattctctggcctcatgtatacttagaaaatctatattccaaatattttttgtagttttgttctataaaaataatacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatannnnnnnnnnnnnnnnnnnngaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccctttattgaacccctcttccactttgttcatatgaagaaggctaataaaactgcctaattttcagtccttgtatagatccctcttcacataaaggaagggagagtgaatttttaaaataggtgaggaattttttttagcaaggtcaaggccaagttcttctagcgtctaaaaggaagttccctttttctgtttttgttttttgtgttttgttgttgtttatcccgtttttatttgtcagtgggatgcttgtatcattttcttctaaaactattgttgaaatcccattaattgcagtaatctgaccattccgtccccccacaataacttcagacttgtcctgaataaatcattttctattccgttcccttcatcaccctgcccaatcctcatcctcacctccagctgcactctgcttcgagggatgcatgcttttctctccgatgtcattttaggcaacttttacactttctacccccatgatgaaaataagatattatgtactacctcgctattgactttgtgagatcttcccaggtcatcttttgggatgacccttgttccttcaaattaaataatatttccataaaatatctccttccattttttttttcgagacagggtctcactctgttgcccaggctggagtgcagtggcacaatctctgctcactgcaacctctgcctcctgggttcaaatgattctcctgcctcagcctccccagtggctgagattacaggcaagcaccaccaagcccggctaatttttattctatttttagtggccaggctggcctcaaactcctgatctcaggtgatctgcccgcctcagcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttctttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctggcgtattttcttaactagttaactttaatcagcctttatatacatttagtgtttaatatactaaccacaaatgagttgggtttgacccattctcaaggaagattggtaagcacatatgtgtttcatttttgcccattaatctttcttcagttcacattccctctgtttaatatatttgctaaatttaggcaactgctgttttagatagagtaattctgtgttgctttatttattttttattttttattttttttgagacagagtctcgctctgtcatccaggctggagtgcagtggtgcaatctcagctcactgcaacctctgcctcccaggttcaagcgattctcttgtctcagcttcccaagtagctgagattgcaggtgtgtgctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatgaaggataattaccaaaactgtatctaatatctattatctttaggatgagtaatttagataccctttccctattgtctgttatatactcctttcccactagccatgtcttagacgaaataactatttagcaggataaaatacctagagtacttttatcttttgctttcaacattacataactgtctcttgtataatcaagccataatatgaaactaaatcatagtggaaatttctatttagaatctttttgcctaagctgaatacacagcaatcatcaacctatggccaatcttatttctactatactcacatattctttctccccacagataattttaaaacaaatgccagacatttcattttatttgtaaatatttcagtaagtatgtaatgatcttttttaacattcaagggaatgtcaaggaaatattgtccccactctcacttgacagatccacagagcaggtctttcagaacccatatcagaaagaggcaccttcttcacctctccatgtgcttggccagggcagaatgtgctttgtgttcatggccagccattttcacgtgtgtcagtcacagttgaatgagtacctttgacaattgcatcgaaccagagtaaggcaagatgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaacaaaaaaaaccaaagagataacaacaacacacaattctctaataatccttatgaggcagatatttccatttatttcatctcgccgaatttaataagactctgagttttctcaacataataggatgaaaacaaaaccgattttttatttatccatcaagtaactggaattgtgctgataaggtggccactagccacatttggctattgagcacttgaaacatgatcaaattgaggtttgctgtaagcatggaatatacaccagatttcaaagacttagtacagaaaaaagaaggtaaaaaaatgtaatgttccgttcttttgctttatgtgctctgctgattatgacccttaacaatatgtaaattaaattgccaataagtacaaatttaacctgatttttttactctgcctagagtttgacaggaggagtcaatggaggtgtccactgtacagatgtaacaaatgcaagtaggactatgcttttcaacattcattctttggaatgggataaacaactctgcgagtaagttctgttttgctctaaatatagttttcccaatacactacctatttataaccgaaatcttaatattttcagatgtcagtggagcaccaaaatttaactgttgatatttcaactacaatatgcaaatctatgttatgtgttttttaaagagagactattattgcatttataataaacaggccaaattaattattcttcacggaagtttaggttcctttataaaagtactttggtttctgtgtgctttctaatttttattgattggcttgcataaagttagaatgttaaatatctaagaatacagctatgttctgttggcttacgtatttattgctatctaactccatgctcaaaaacatccatttctaattgttatttatgctttttgcatttaaatacatataaatgtttctagatgtctatttaaaacagtgttaaatacccaatcttcttgtttttcagattttttggaattccaatggaaattcttccaaatgtccggagttcttctgagatctatggcctaatggtaaaaaacaaacaaacaaacaaaaaacacaccaaaaaaccaaaaaacaaacaaaaaaaaacctaataattaaagtttttttattacaaaacaagtttactattcataattcaaaagtcaactgtgttatgttttgtgacttaaaaactttacagtcctttttacaatggatttgcatttataaactttaattggtttttctttgagtattattatttttaaagaattgatgggatactctaactttagatgttggcatgagccaatttattctttgaatccaaataactgtttagtggttgtgatgtctgcttttaatttagcggagagactctgcatatttagtagtgttctttttcccgttgaatcttttttatggccaagctatgttatatattagattctttgcctgagcaaaatttagcaaagaaactgaaagcaaagagtctgtttctgatttgggattgctaattaaactagtttctgtaatggacatttttacttttgatttcactgaaatccagtaaagacatagcttcagcaaaagtgtgcctagcatcattaagagtctgtggttaaacatcaggaatgaaaacctctaggaggatttgcactggtgtttgagcacaaaaatctggaatttatgataagactcaggaataagtctgataaattacaaaaagtattgcttagacatttcatgaaagatatgagaaacttcacttacaaagttaataataatatagatgaacactaagtgctctggataaagcttgagcaagaatttttaactgttttatttataataaagctttttaaggcaacatagaatttcttaaggaagccatagtcactgcttatctacagtaaaagtgctttgatcatttcatagctgtctgcaaactgacttgggtcaaggaaaaagaaacgatgcttgagaaatagtttcacaggatggttagaaaaaaaaacgtggaactggcctagttttctcttgtatttaaaatattatgcttctatccttctctctcccccttgctgactatagaaaatctctcatagcgtggtgagtaggttgcccgccaattatgtacccattcatttggaaaagatacagtgcacttccatttatttttagacaagcagaagtccatttactaaacatatatatctagaatttccgtgaccttccaaattattataagctctagtcagattttaatttttacaaaaacttaatcttgtttgtttttaaagagtaatgttctaaaataaaagactaaggtagtttcctggaatgagagattctgatattctcataaagtacaactgtgatgtgctttgggctttaccataatagggcaattagatagatacagtttgaaatgtctattttaaatgatatattgaccacctttccagaccagttagttggaaatgcactgttactttttctgcatgcttcatcaaggatgctccaggaggagcatcagaggtccctccctctgaagaaaaaagagcactttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggaaatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccgtctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttatttttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatacctggctagcacggtgaaaccccatctctactagaaatacaaaaaattagctgggcgtggtggtgggcgcctgtagtcccagctaccggggaggctgaggcaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttgaaaggagtttcgctcttgttgcccaggctgggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattcctgtatgttccccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaggatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattgtagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattatctctgcttagtgtcttattataactgaaagaaggtttatcattacaaatgccttccaatgaaaccaagaatttctcaaaatatttaatgtcacatattataagaagttacctaatcctgcttcttaacgtcaatttttaaaaatatcttaaaattactttgttttgcagtaaacagtgaagaaaagattgcctcctaattatttttttcaacgagtgctgaatgggaaaacatttatatcttactataaaaggttctgttttgtttggaattaatggtagctttattgactgttctgattgtgctgtttctgaattattgaatctgctaggttttattcatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctactaaaaaaaaaaaaagatgtttcaggacatgtgaaacttggctgttagcgcttgatagggcacactctgaagagttaaccaacagccaaagaagtaatttctgtaatgatgaacactttaatcattctattagaagaaactacactgtcccatctcagcatttgcaaaaaataatgttggtaaggtcagcagccattatcaacagggccttgcatggctaactttgaccaccatttttctctcaacctgataggcaacacctcaatcctttgttctccaactaatcagtaaaataagtaatgcatctctgcttctgtaatgatatcttagaatttttagtatgtttcttttgaagtgcccaaagcccaattctttgggatat

SEQ ID NO: 14502 - DNA, 38346 bp, Human
  misc_feature (1)...(38346): n = A,T,C or G
ctcaactcttccatctaacacctttccccttatctttacctcatctctaacagggtgctgagatgtgacgcctgaaaggccaatattttggcttttcagttttgttttggtgaaaggaatgaggatgtggaatacacattgttgtaggaaccataggatcaacaaatttaagaatcccccatgtacatctagcccaacttattctgaaatgtctgaattctgatcccattgtgctgccaaacaaataatttgctgtcctgttggaatctgagagtcaaaagtatgtgaaagttcaaacgtggtcagggattttttttttttaatggatcgatgtggtaggtttggtggctttgtttttactgccttctagaaccaagaaaatccttttctatatcattcactcaactaatgcctttcactgtttttagaggcaagttggcctggttccttgcttatatgcctgtctccctcttttcctcttccaggaaattcagagatactgactcatcttcactcttatattaaagcaagccagtttatcgatagttattaaatctagtatgtccataagcaggcttcatctggaacattagaatgtgaggtctagacggtgtttaggaaaatttgctttcagatcatgtgtggtaaaactatacaaacagagatggacaagtgacgtggtgtagagcaaggtaagaaaggaaaaaaaaaaaaaaggaaaagaaatgatgttccagaacacagagatttgggaaagggatggaaagaaatgacagtgggtatagcggagtgcttttaaaattgatagagagcatggtgggttacaaaagcaatttagtgattttcaatcagcattaaaaaaaaatgatatgccatagaataaaaatacagaatgcatactgtggaaggacaaatattgttttggaaagtttttctatacatacataaatgtatattagatgtatataacatgtatttacatgtgtaacaattgtaactacaaatgtgctccccgcccacacacactggagcctgggtttgttttgtaaactgtttcacagtgtgggtcttggttccaagtttgaaagcccttagaacacaggatccagaaggatccgggcaaggtaaattcaaggtcaagggagagtcccttttctgtcccctgccatccaaagcagttaatggagggagaggaaatggcgtgtgggggaggggaccgcagagtgaggccaaacgaggagcaagggcgcgtcaggacggagtggtgccgggcgccttctgcctgaatggtcgatagaggaacttggggaggttgattttgggtgctttccttaaatgctaaaccgaaagaacttccgcgtttcttgtccctgaaaagcttgcaacggtgaaggattcgcgttgctccttgaggtgaccctatatggggtcaatcccagccaaaggaatgattacgattaccaggggccagatgcagggaggtgggcggggcgtgggaaacgcgggaaggccgggccgggtaggtccacacagcgactcacgtcgctgcacgactctgcacagcccactggagggaacaagcagttctacacactttgagacccctatggaggcgagccccaggacactagtggaagtgcgctcttttcgccggccaggagcgctgcctgccaaagggcagtactcgtctccgccccatgccatgcagctggatggctctgctgtccgctcgccgggcccccacgtgacctactgcgcgggccgccgcctccaccgcgcccaggccccgcccccgtgacgtctcatcgccctctgcctgtccgagcgttcggctcttttgcgtttgctgattggccagcccaggtgacagcgcccacccccaccccccctgacacgcccctggagccttgggggtacgcggtggggggcggggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgagccggggcgggagtcgggggacggagggggtggctgttgtgtccccatcccgcatctctccggcccggtgccccggccgctgggcaaggagggaggccggaacgggacctgccacactggggatgccccacccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacaggacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaaattctgtttctctttttatttaccatgtgtgacagcacagttttaccacaaaagattgctatttaagtgactgctgattaatttttgtgcaattagtaaacttgctcttaaagtgacctagcacagagttcagtaagataatttaaaagtaattgaggccgggcgcggtggcttacacgtgtaatcccaacagtttgggaggctgaggcgggtggattacctaaggtcaggagttcgagaccagcctggccaacctggcataacaaaaattagctgggcgtggtggcgggcgcctgtaatcctacttacccgggaggctgaggcaggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggagtcagcttgaactgtccatgccttctttttgactgttcattattgctgtccatgtagcccagcaatcttctttattcactacaggttgttcttggtccctcaggttttgttgcctaaaagacatctttctacatcaatgaagaagaacttgatcaacttcatattaccacaattaattgttcagtctgtaacatgaacaacatgagccttcaaaaattggctcctgtttactgggttctgtgaggcctcgtctcattgcatgtaagctaagatgcaaattcagaagattcttatcctgcttagagaatgattttataaaagttgatcagtaaaattgtcctctccttgagaaacaactatgaaagcatgctctagaggcaaataaaaaaaccgtagagatcctgtgtgaagtagtgaaaaacttaggaatggtttagcaaggtgttttttcctttgtttataaggagagaggttgctaaaccactccctgcaaaatgcagataaaagatttgctgaataagtgcttcaatcacaagatgattcccgggagttattccagtcatattactccacgttgtaattatgactgaaaaataattgcttacctctcaggaaagaatacagtggataagaactgtcataaggaagcttataaaattaaagatatttaagtaatttcctattattcattaaatttgcatatttaacttgactttcctgagaccaataatctctgcaagctttcttcttcttttttctctgttagcaatattagctttctcccataaggagaaaaggctttatctgtgctctttcatcccagggaaatgcctccacctctatcccacatatccgcttctctacctctaaatagtggctcaactgccaccttttagtgtaagtcttcctcaaaccgttattcagaattccccccccttcctacagcacttttaaaaatacttctattaatagctcttattaccttcccccttgtattataatcgtatacctgctgtacttgggagcagggtcctccttttaagctatttgtcatgttgaccaagatgttttatgaaatacaaagatgaacagcacttaaagactgttcagagagtgttttatacatgtttattgagtagatttttatttctctttaataagttaactgaattattttttattttattttatttttttgagacagaatctcgctctgtagcccaggctggagtgcagtggcatgatctcggctcactgcagcctctgcctcccaggctcaagtgattcttctgcctcagcctcctgagtagctgggattacaggcatgcgccaccacgcccggctaatttttacatttttagtagagacggggtttcaccatgttggtcaggctggtctcgaactcctgacgtcgtgatccacccacgttggcctcccaaagtgctggtattacaggcgtcagccaccgtgcccagccaagttaactgaattttaattctggttttctttcttacctcttaaaacattcttgggtacgtttggttacttaatttcttcttacattttagtagtagacatacaatagaacatgttcatttcctcatcaaattgtcaaagaattaatcttgggaccccatgcatatgctttgtacaagcggaaaatttccaacttatctgataggaaagtgaattggggttggcacatggtaactcagattgcagagtaggaacttcttggaaagagaattagtgtaacaggttttaaggaggggccatttctttgtaagacaaaagtttcagcttaaacaatcaacttccttctttaatttggtaacttaattttttccccactatgatgattttttaaaagacttgtaatgtgttgtggcttgaaatgtgtcaggtactatgttgaagacttttccagcattatctcatttaatcctcataactctgtgatgtagatcgtattagtaagcttctttacacaggtgattagactgtggctgaggattgtgcccaaggtcacagagtaactggtggagctaggattcaagtccaggtctgttatactctgaaaccagtcctcctgactactgccttgggttccccagctgtgtagagtactgtgaaggggaaatgagagaagggggaggccaccttctcacctattaatcaagtgtcagttctgattatcatcacgaatgaatcttcaccaagaaaaacatacttataaattggttttgcaatctataaaaaatattgcctttgaatgagtactgtgggttatgatcatcttgtgactcaaattcagtgggtcctaggcagggctcaggtgtgtcactgtggataatggttgcatcatcattttgtttcaaccgacaatacatataaagaatgactagaattgtagctcagtgcttgttttggcaggaagcattcccttggccccagctgtcccatcatacttagagatctcataaggcttacagatggatttcctctttccttcatttatgtattcaacacatttattaagcacccattatgggccagggactaatgaacaataaattttggtaaaactgatttggctcacagttggaatgaggccactcttgtgataagtagagttgtgattctttttgttttttttttttctgagacggagtctcactgtgttacccaagctggagtgcagtggcacgatctcagctcactgcaccctccgcctcccaggttcaagcaattctcctgcctcagcctactgagtagctaggattacaggtgtgcgccaccatgcccagctaatttttttgtatttttagtagagacggggtttcaccatgttggccaggctggtcttgaaatcctgacctcatgatccgcctgccttggcctcccaaagtgctgggattacaggcgtgagccaccacgcccggccaagttgtggttcttttgttgtttctttctttctccactacatttgcttgtttccttgcccatcacattacacaagtaccaggaacacattctcaacagagagctgccacccactcttgtcttgtctgtcacaagactaagtggtaagagctttcaattttgagcttcttgagggatagaaccatgtcctttttcttccccaaagcctgacacagcatctggcatgtggtagacacatgttacatgaaccaacattagcagcaagggacctgcaaggactcaagtgtgttgactggaacacttggattagaatagaccgataaaacttgaggcatcttggaaaaagtcaaaatcagaaactatagctctatttgatgtatgtatatgccatttactacaatttctttctttctttctttcttttcctttttgagacagagtttcactcttcttgttgcccaggctggagtgcaatggcgtgatctcagctcacggcaacctccgcctcctgggttcaagcgattcccctgcctagcctccccgagtagctgggattacaggaatgtgccaccacatctggctaattttttgtatttttagtagagatggggtttctccatgttggtcaggctggtctcaaactccctacctcaggtgatctacccgcctcggcctcccaaagtgctgggattacaggcgtgagccaccgtgctcggccaatttcatttttaagaaaaacataatttcatttgctatgttttctttacttctgtggcttgttggaagatgccttttctagtcaaatttggcatggaacatatttgtggctaatatttttattttcagtcactcacatttacgtagtatcatggtgttctcaagaggaagtttacatttctgaataatgtcttatcacatggtaaagtttagtgtgtcataaaagagtagactagtggggaaatcacatggggagggaaatgaatgtgcacatttatgataggacagatgaattagtcataggatgagtgaggcaagcctacaggacagttacttagtaaagagagcatttcagctccccagaagtctcattcttataaggcagagaatacatgtgttgtttcagaagctaatttttaaatattttttgtttttgagacggagtcttgctctgttgcccaggttggagtgcagtggtgtgatctcagcttactgcaacctccacctcctgagttcaagtgattctcccacctcagcctccccagtagctgggattataggtgtgcaccaccacacccagctaatttttgtatttttagtggagatggggttttaccatgttggccaggctggtcttgaactcctgacctcaggtgatccacccacctcggccttccaaagtgctgggattacaggcgtgagccaccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgagacatgatttgggtttagagatgaatataggactggcttcctatattcattattcagaatgagtgatttctaatccttattctgtcatctattagtggtggtgggagtagtaattgtaataaaagtaattataaaattagtagcagtagtagcaacaatgatagtgttgacaccttttggatgtatactctgtgcctattctatgctaaatactcttcataaattactttattatccttttacaaatgaaaaacatagaggctcagaaaaaagtgtcaaatagctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttcttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattacaggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtcctttctcctcttcatagccctgacagccctatgtgaggcagaagttgcagtgagctgagattgtgccactgcactccagcctgggtggcagagccagaccctgtctcagacaaacaccccagcaaaaaaccaaatgaccaggctagacattgtataaagcaagtgatacagccactgctatctttaattgacaatgatttctgaaatgtacttgaaaaaatcagactagcattcttgcctctgggtactgtgttttaatgtggagttaattatcctctaccatagagtcttgtggaaacatcattagccttctttgtacatttggccatctgcagacaaatcaatggccagaaggcttcatgtgaacctagatatatgaggaaaaaagtactctagaacttcatgtccagtacaatagccactggccacatgtggctactgattactttaaatatggctagtctgaattgagtagactgtaagtgtaaaatatataccagatttcaaagacttagtaaaaacaaatcattaatattttatatctatcacatgtcaaaacaatagtttatagatatattggcttaaatgtgttattaaaattaatttcatatgtttctttttattttttaatgacacaatttaaaattagtatgtggcttgcgtttttggtttgggttatatttctattggacaggctacatacactaaggtggtgtcagtctcctaagtttcagagctttgatgaagtagggaggtctaggctccatcctggtacatccaaatgttgtttgattggatggcttcatggtctaatacagcaaatagaatttaccaaaatccttctgttttctgtgtctcttccaaagatccatgaattcatttttagcataagggccctgacgttgccctagttaaaactaggaggtgatggaagaggggtctcattccattcagagccccataggtctgctattgaggtttttatgaattcagccagcaaaaagggacaccttgtttctttctttctttctttctctctctctttctctttttctttctttctttctttctttctttccttctttctttccttccttccttccttccttctctctctctctctctctctttctttccttccttccttccttctctctctctctctctctctctctttctttctttctttctttctttctttctttctttctttctttctttctttctttcttttctttctttcgtagtttcgctcttgtgtcccaggctggagtgcaatggcgtgatctcagctcactgcaacctccacctccttggttcaagtgattctcctgcctcagcctcctgagtagctgggattacaggcatgcgccaccacgcccaacagatttttgtatttttagtagagacggggttttgccatgttggccagggtggtctcaaactccagacctcaggtgatccacctgcttcagtctcccaaagtgccgggcgtcagccaccgcgcccggccaatactttgttttcttaacctagagtcctttagggatttgagagtagcagggagcagctgtaatatgaataacagtaacacagctggaatttcctattgtagtgaagtttttctgcacataagtgtttctcattttatctgataatttttgtcctaataagtacatgtaatacatcatgttttttggacattcaacaaatacttattgagcaccaactttgtgcctggcactattctagttcctagggatacttcagtgaataaaacagggcaaatggaactggcttcctagagacacaccctaatgctaatggagttggtatcctagagacataccctaatgctaccttgtaaatcacagggctatcacatggtgtatgatgtatcaagttaacctttgacttgtaagatattttatcttctcaaaggacttcagaatttgccctcttgctttcattatgtttattatttcctccagaaaagaggaaagggggcgtgtgtgatatagaaggaggaaggcaacattcaacgctttttattttcttagtctgcattgaacaggtaattttctcccacaggaaacctaggcatggaaacactttactaattggaagtgacttcgctgctgtaattagagtaattttggaagttaattttaatcaaaatatgcatcttactctgtaagagtaagtactttggtactcaaatatagatactataacatggaaacaatatatatgaaaaacttgctctctctctctctgtatatatatagatatctatatattatatatatattttatatatatctatatatattttatagatatatattttatatatatctatatatattttatagatatatattttatatatatctatatatattttatagatatatattttatatatatctatatatatttatagatatatattttatatatatctatatatattttatagatatatattttatatagatatatagatatatatatatcttatatatatatatagatttttttttttttgagacagtttcactcttgttgcccaggctggagtgcaatagcgtgatctcggctcaccgcaacctccgcctcctgggttccggttcaagcagttctcctgcctcagccttctgagtagctgggattacaggcatgcgccaccacacctagctaatttttgtatttttagtagagacggggtttcaccatgttggctaggctggtctcaaactcctgacctcgtgatccgcctgcctcggcctcccaaagtgctggggttataggcatgagccaccacgcccggcaaaacttgctatattttaaaaagtgttgtttttagtagtgctaaaattgtagaggatcgtattacacttctttgttagttttcatccattggttttaatgttttatatcaagggtcagcaatttatgacaagcatgtcacagagagtactcagctggatggggccaagtatatacttatccctttactaacaaggactctattgcctttttttttttttttttttttttgagacggagttttcctcttgtcgctcagggtggagctcaatctcagctcactgcaatctccatctcctgggtgggttcaagggattctcctgtctcagcctcctgagtagctgggattacaggctcccaccaccacgcctggctaattttttgtgtttttagtagagatggggtttcaccatgttggccagtctggtctcaaactcctgaccttaagtgatctgcctgccttggcctcccaaagtgctgggattaaagatgtaagccaccgtgtctggtcttctatttctcttttataagagctagatgcgtagccacacttcccttcaaaggaatctacacagtacgtgtctatgtgcctgagtatctgtgaccctttctgtttccacgtccaagataaatggagtggaaacttacaccattgctattagtattgtatcagctctcttttattattcttggttttcctattctgtaaaataaatccatattattaattaatgtgttaaatttccgagaaccattttggttttttaaggagtagggaattgcttcttaatttacctttatcttcaataggtttctttttacctaaagagaagttatttctgatgctgccttatatcttttatgaatccatatgaaaagaaagtggaacatcttatatggcatttcatctaattggactttttctaccagtgaacaagaacttcagttactgaataactttaaacatccttgatatctgcctgcatttttacattaatattacaatatctttttcaggttttcaattcaaaaacagctgaactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcagaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttcactcttaggaatttacccaagaggaataaaagcatatgcccatcgaaagacttgcacatgaatgtttatagctactttattaaaagtcgccccaaactggaaaccacccaaatgtctgtcatcagtaagatggataacaatggaatgccatttagtaattttaaaaaagtggacagatacttgcaccaacacaagggaatgtcactggaaatatggaaaatgaaaaagttggatacaaaagagtatatactgcatgactccatttatctgaaattttataatagtctaaactaatctaggatgataggaatcagaaaagtggttgtctgtgaggtgtgtgattcacttgaaaggagcatgaaagaactttctgggttgctggaaatattttgtatcttgactggggtgttggttagatgggtatttccacttgtcaaaactcagcaaattgtgtgctttcgatttgtgcatttcactgtaaagtttacttcaatttaagaaagagagaaaaaaattgatgcgtttctaaattgtattgtcttcttcacatgaaaaaatgttctaattttttagagttcctttgtttaataataaaagttattgatatgttagaggcattagcatgactgtccacaagcctgaacccagtgcaatttgtaaagaagatacctgagtcttggctagatgaaaattataaatacacagaaggagactgggtttttaaaaataaattagagacgacttggcgcggtggctcacgcctgtaatcccagcactttgggaggccgaggcaggcggatcatgaggtcaggagatcgagaccatcctggctaacatggtgaaacctcgtctctactaaaaatacaaaaaattagccgggcgtggtggcgggcgcctatagtcccagctactcgggaggctgaggcaggagaatggcgtgaacccgagaggcggagcttgcagtgagccgagattgcgccactgcactccagcctggacgacagagcgagactccatctcaaaaaaaataaaaattaaaaaattaaaaaaaaattagttagagacagaattcaaagcccaggaaagggaagcatttagttaggcctgagaaaggcagagaagaaaggcagttggaattcccttgctacttctggatcctatggtagaatcattttagtttgtatcatttctacttttggacttcctcaaattaccatatttctcctaggcttctcacccttctcatttactattagcctttcatccttctgaggccctggtactttaccaaaattatactgagattgggtctgagaacttggaccaatcacttatctacatgaaatagttaaaaggagttttaaatttctccctaaattccaacaaaacattttgggaaaaaagtagcaaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgtgtcaaaagaagactaaagatgttgagcagtgagactgggtagggggtttcagtaggcgatcaaattgtggaagtgggtcgggcttcatcagccatatttaggattttggatgttattcttagtatcatagggagccatgagaaagtttaagcaaggcggcaagggatgacttgcagtttcaaggcaactttctgactgctgtgtggagagtagatggtaaaggcaaaagtgtggacacagggagactagtgcggaggctgctatggaagtcctgagagaggatggtggcttgaccaataatggtagcagtggaggtggagagaaagggccagaatttgctgatagactggatgttggggtaacagagagagtagtggggttgagggaagagattggtcaaaggtgatgctttggtttttgccagagctcctggatagatgaggatgccttttgctaaggagagaaagactagaggaatgagtaggttgtggggaaggggtatttggaatccaaactcttcacttctaaaatttccctgaaataattgcttgagggtgttagattgttatggatttctctgagaagtcctagtagttttttttttttttttgagatggagtctcgatcttgtccccaaggctggagtgcagtggcatgatctcggctcactgcaacttccacctcccaggttcaagcaattctcctgcctcagcctcccaggtagctaggattacaggcacacaccaccatgcccggctaattttttgtattttttgtagagacggggtttcaccatgctggccaggctggtctcgaactcctgacctcgtgacccgcccgcctcggcctcccaaagtgttgggattacaggcatgagccaccgcgcccagcgaagtcctagtagttttaattgaatatctatgtttggcttttcatcattcatatagggaaaaaaaatccagccacccaagattgatataatagcataaaaggtggaagcatagtgtggaagtttgctgtctactttatagcctaaaattttcaagtttaccattcaagggctctttttttcctccttaggtagtttgactatagatagagagaacatcaattggtggtggtggcttgattgccatcatcttggctttgatacttaccatcgctcctgagcctttcccctatttgtataaattaaaactcacttaaaaaaaaagactacaaatctatagagtgcctactatgtgccagatgtgctaaggatacaatggaggtaatgcttaagtgcagaaaacatgttaatctgataatcacaaataaatggaaatgcataaaataatagagttatttctgttattgcagattttttaaaagtataatttgatattttattaacaacttttaatactatgcacatattaatcctatcctccctttatccctacatctaagtggaagggcttcaaacttctcttagggttgtagtcctgaactttagatgagttgtgcattagtgattgttgttgatcatttccttgagctgttcttgcacttctcacagtctaaacagtgcaaacaaataataggcaatcagtagcacactcttgtcaaaattaccaaagacgtaagtaatccaggcagcttaaagccatgtttagaatgtagagtccagggtgattgaccatggctttgacatcattctacctcccttacaggtaaggtaggttgtgatgtgttggctttctggacccacttggatgctattcctttctcccttgtttttacggttatgtgaagatgacacacaactcctgcccaagtgatttgtcttccgtttgcactacctggtctaagaattgaacaggcagcttctctatactcctctgtgtctggccagtgtgaagtccacatctgagccaaactgacccagcacttccatctgtacaactaccatcctctggccacagaagagaacatcccacaagctcctccataccaggccagttgtactatttttttttttcccagaaaatttatccaattggcattgccaaggaccaagcttttgcttgcctgcatagaactctatatcacaaactgttaaagctgtaaaggaggctgggtgcagtggctcacacctgtaatcccagcactttgggaggctgaggtgggtggatcacgaggtcaggagttcgagaccagcctggccaacatggtgaaaccctgtttctactgaaaatacaaaaattagccaggcgtggtcgtgggcacctgtaatcccagctacttgggaggttgaggcaggagaatcgcttgaacccaggaggcagaggttgtggtgagccgagattgccccactgtactccagcctgggcaacagaacaagactttgtttcaaaaaaacaaaaccaacaaaaaaggctgggcgcacagtggctcacgcgtgtaatcccagcactttgggaggtcgaggcaggcagatcacctgaggtcaggagttcgagaccagcctggccaacatggtgaaaccctgtctctactaaaaatacaaaaaattagctgggcgtggtggcgcacacctgtaatcccagctacttaggaggctgaggcaggagaatctcttgaacctgggaggcagaagttgcagtgagccgagatggcgccattgcactccagcttgggcaacaagagcgaaactccatctcaaaaaaaaaaaaaaaaaaaaaaaacaacactgtaaaggatcttcagtcaactagaccagctccctctatctgcaaattagggaagaggacttaactgcaggttatgtagctttttagtggtagattaacattaaagcacagctcccctgactcctagaccagagttctttttcctgagccacactgatggtaatctcacaaaccacttctgtttttatttcttgtgtggcaagtaaattaactttgccaactgaagagtgatatcatttatagtcctacctgacagtcattaagagttcttcatgtctggtatttccttggcaaatttcaatttcattggttttgttatgcttatctgacagaaggtttgttgatttcaagtcactaggaacagtgcctccaaaattaaaattcactctccaactgagcagcacacactagctcaaggcaattaaatagactgcttctttccttctagcggtagagtcagctctgtttgcctgtcactgggctcaaggaattacaaagtataaagagttacagtagcaattccaaaatacaaagagttacggctgggcatggtggctcacacctgtaatcccagtactttgggaggccgaggcgggtggatcccctgaggttgggagttcgagaccagcctgaccaacttggagaaaccccatctctactaaaaatacaacattagctgagcatggtggctcatgcctgtaatcccagctactcaggaggctgaagcaggaaaaacgcttgaacccaggaggcagaggtagcagtgagccaagatcacgccgagccgagatcatgccattgtactccagcctgggcaacaagagcaaaactccatctcaaaaaaaaaaaaaaaaaaaaaaaaagagttacatattcattcatgtgatagaacgaaaacacaacataaactctttcaaaattgagagcataaaattctcagagattagattatcttgtatctaaaacaattatttccctgttagagaaaagggaaacccacatatccattcctccactgccttgccctacccaacatattcacacacatttctaccacctcttagactcatactgtcaggggcctctcaggggtttcaggaaggcacctcgttctccaaaatgtttccagcagcagccacatctcatttgcaatttttctaacccacctcaagtacacatcttccagagcctgttttaaaaagttttatcaggccgggcgcagtggctcacgcctgtaatcccagcactttgggagactgaggcgggcggatcacctgaggtctggagttcgagaccagcctgaccaacatggagaaaccccatctctactaaaaatacaaaaattagctgggcatggtggcgcatgcctgtaatcccagctactcgggaggctgaggcaggagaatcacttgaaccagggaggcagaggttgcggtgagccgagatcgcgccactgcactccagcctgggcaacaacatcgaaactctgtctcaaaaaaaaaatgaaaataaaaagctttatctctcttcccacatggtattcctttttgtagccagagaaccttcctctgaagctcttattattttgttctgtgtgtttttagttttctcctaaaaaatgtgttataattatatgttatgattttaattttaaaaaaggatgcatctcatccataattctaccaagacaacaattattaacatcctggagtattttcaaaggctcttttttctaaggtatattttcttaactgtgattataacttcacggaaaattttaagaaaaattaaccagggattttgagtgtagcttttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaaactcttgccctgttttggcagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctggtaatccatcctctcctgtcactacatcagtcagaaccaagtccccattgattcccagccccatccatcccctcattctcctttctcttctttatttacttttataaacatttttgtcttacccagaatctcttccttataccctatgcctctaaatttctttggagtagaatctcaatcatctttgtatctctagaaaatattttttaaaaaatatatatatatataaacttttagatacagagggtacatgtgcaggtttgttatgtaggtatattgcatgatgttgaggtttggggtacagacccgtcacccagttagtgagcataccacccaataggtagttttagaaaagatgttgaataaagtaagtcaatctgcattggataaatagtattagaacaagggagctgatgttccccctcagctctgtgctggtcagaacattcctagagtattgtgttttattctggacgtacagtttgagtgatatggacatacacttgcatgttcctaggcgtggtgataaagggactttaaaccatgccatgtttaggtggggtcagttgaaggaaattggattgtttaggctacacagcagaagagaagacttgaggtacaaaagagctgcttcaagttttgaaagactggcatgtagaaggattacccttattctatatatctccaaagaatatgactaagatcgggaggtggaagctacacaaaaaatgatttttttttttttttgagacagagtcttgctctgtcacccaggcaggagtgcagtggcccgatttcggctcactgcaagctccgcctcccaggttcatgccattctcctgcctcagcctcccgagtagctgggactacaggcgcccaccaccacacccggctaattttttttgtatttttagtagagatggggtttcaccgtgttagccaggatggtcttgatctcctgacctcaggatccacccacctcggcctcccaaagtgctgggattacagacgtgagccaccgcacccggccacagaaaatgatttttattcttctttttttttttttttttgagacaggatctaactatgttgcccagtctggagtgcagtggcaccatcagagctcactgcaaccccaaactcctgggctcaagcaatcctcctgggtagctgggactacaggcgtgcaccaccatacccccctaatttttaaaatttttttttagaaacaaggtccaactatgttgcccaggctggtcttgaactcctgggcttaaggaatcctcctgagtagctgggactaaaggaacacaccaccacacctggctaatttttttttttgagatacagtctccctctgtcgcctaggctggagggcaatggcgcaatctcggctcactgcaacctccgcctcctgggttcaagggattctcctgcctcagcctcctgagtagctgggattacaggcacatgccaccatgcctggctaattttttgtatttttagtagagacagggttttgccatgttggccaggctgatcttgagctcctgacctcagatgatccacctgcctcggcctcccggagtgctgggattacaggtgcaagccaccacgccaggccatctggctaatttttaaaaatttttttatagagactgggttttgctacattgccgagggtggtcttgaacccctgggctcaagccatcctcctgcctcagccccgagtggctaggactacagttgtgtactgctgcatctggctaattattttatttttttgtagaggtgaggtcttgctacattttccagtctggtggatttacaaaaagaaaaaaagcaccaaagttgtccaatggagattgctctgccttgagagatgtagtgaatatcttgtcactagaagtgctatctggatggtcatatgacaggagattctagagaagatttgagcttgagaagtatttttgcttatacagcctttaaggtctgtcctaatcttaaattctggaagagctggatcctttggccaagtgtgttctatccaggatgcacattagaatcacctggggaagttttaggaacccataccaatgctcacatcccatcccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatataaggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaagaaacacttggcattgggtattgactttttctggagccactcaaagaaaataaactaatatcactacaaatgtttcaagtatttttttgatttgctatgtttagttgtgtctctagtaagatgagagctgttttcctgaagtagtttcctacttgttaaatttttgacttccttctgtttaactttctctttaaagctattggtgtcagcaaccagagggaaaccactgtagtctgggacaagataactggagagcctctctacaatgctgtgggtaagctgtcatgcatggatgtcaaatgtagggcctttcttcacattgcaaatgtggtcatattaaaatatcttgctaaaaaagcatgcagtcgccaggcatggtggctcacgcctgtaatcccagcacttcgggagactgaggtgggtggatcacgaggtcaggagttcaagaccagcctggtcaacatggtgaaaccccatctctactaaaaatacaaaaattagccaggtgtggtggcacacacctatagtcccagctactcgggaggctgaagcaggagaattgattgaacctgggaggcagaggttgcagtgagccaagaccttgccattgcactccagcctgggcaagagagtgagactccatctcaaaaaaaaaaaaaagaaagaaaaaaaaaaacacatgcagtcatggtacctataatcttgatgggatgggcagaagagtctgctaagaaattaactgttgtatatttaccatttttggatcatacatattcacatagtgaattaactctcccatgctctctcctcttgcagattgtcttacaaatgagtgaatgtttgccaaattgttttataacccctgctgtttgtgacatctaaaagagatcttacctccttaccctcaaaaaattaaaattacgtgtgttcacagtcatttttctataaagtacttgtgtgtttgtctttccatctaggaatttgaattattcttctaaggttataaaaatagaatattcgaattttagctgcttcttctacaaatgtggctatttgagcagggatttaaaaaaccccaaatctcaaatataccacttttaggtatcacaacttattaggtgtaaatgatcctgagtatattttagcatcattattagcatgacagttgttgaacaccgaatgatactaccacttcctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggattacaggtgtgagccaccacacccagccagaagtacatgttttaaatgtttattttgttctcattctcatgagtaattcattttgaatataagacagactatttaatgactagtatttaggagagtatcctttgatagatcaatgttagctaacttcctgaactagttaaggttttactttcttttgttttcttaatgaaaggaagagcctactcaggcaaaccagaaagttccagttaaattctgagctttttttttttttttctttttttgagacagagtcttctctttcactcaggcaggagtgcagtggtgcaatctcggctcgctctatctcccaggttcaagtgattttcgtgcctcggcctcccaagtagctgggattataggtgtgcaccattatgcccggctaatttttgtattttcagtagagacagggtttcaccatgttggccggactggtctcaaactcccgacctcaggtgatctgcccaccttggcacgcccggctagttccagttatattctaaacattgaattgtaaaaatggaactttggactttggattgttatttttcaaataatgcaactaggtaagctgaagttatgcttacagtaaagatttaagtaaatgttttactagaaaatctttctgtgatgttcttatttacttatttccttctcttctgcctgtgtccctctgcacccctcccccattctacatgctttgcagtattaattcaaatgttcataggatatgaggaactcttttcttctatcctgagccacatacatgttttgagaacctcttacatgtttgatgttatcttgggtactataaaggatacaaattatattggctgtttttttaagcactttataatctagttttggaaagagaaaactagattagggaacaatccataaaacaaaattagggaatagttgataaatcatgtgttgataggttgaaaaggacttagagcaagtacatatcagtatggattttgaaattttagcatacttttcacagtggaggttgaacttcacttgggccttgaagcgtatattggattgcgttaggaaaagagaaaattgaggaataatgtgaacaagctatgaaggtgaaaatgtgtacacatattttgccagagtaaagaaatggatgagtttcatgcataggttgactcatttttttttatttttagtagaactagcagcgataataatactcagtaagtgctaactgctattactttgggattgtgctaagtattttacccatattatttaatctcactgaccctgtgaaacagattttactacccctattttataaattaattgtggaaaagctctataacttgtccaatggcatgtagctataagtagagtaaagccacagtttaaacatgaacactctccaaccttaaagcttgtgttctaatttgggtagacaggggttggtgaggatatagagggggctgaaagccatgcagtgtagtgtagacttaaaacacggggcagcttgaggcaaaacagatgataaaggagagtttagccatcccatgatggtggaatgggttgtttcaaacacaccagtatgcggagaacaaccagaaaagctggatgaaaatgaaataaaattctgaagaactggaaggctaccaaggcagtgaggacagaaggaaagcccagagacataagcctagcatttggcattgcttatctcctggagatatcggtaggttctgaaaggagtatctgacaggctaagccacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaaataatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctgaagatgaatttgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttatgctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctcttagtccattctggttactataacaaaataccctagattggataatttataaacaacaaaaattttattgtttatacattggatagggcataaggaggagggagaaaataaagcaggcctgtgagattttcagcctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttctgtcttactaaattatacaacagatgatatatgcatatatatatacagctgtatataaatatatatattttaaatacagatagggtctcgctgtgttgagtaggctggtcttgaactcctggcctcaagtgatcctcccatctcggcctcccaaagtgctgggattacaggtgtgagccaccatacccggccagatgagcaatatttattacaaacaagcatatgagaggagcacattatgtttccctttttaaaaacttctatgtggcctcctttgtttatggctcagggacacttgataagcaataattcactcacccccactacggtaacagaaaaaccaagataggagaacttcaggatatcattggtggccacggcataggcttgatgaaggtaaagactgagaagggctatttgtttttgcttgcaataaaggtgtgtttgtttattgacatcttttctatcagatacaattataaacagaaaaaaatttaaatgggtccattgaggaagagatggcctaatttacaagttctatgtatttttagaatttatctgttaattatgtgattaataaggtaaacattaatgtgatatctaaaatgggaaagtgttactttgcatcactgctttccagccactgtgccatgatgcaggcatttacaataatgacctcattggtggatcagcaagagctttgtggccctggaaccaaagcaggccttgggcttctcttgcctctcttcagttgccctagtcttcctggtacttctctctttcccttttagcattatcttcaatattcccttccacggggtttcctctacccacccatttttctaagccttttccttccaaaagcagcttttattaatggtctacataactggttgtcttctattattgaaaaagtaaataagccacagactaaactgaccaagaagcacaaaactacccaagtagttaaaatgtgaagcgggagaaggcttgaatcagtgatgtttagtatgtttacacacacattttactgatgctaccagggaaatgttctgtccaaactagaatggcctagctgtatttccccctaattggccaagtttgctcactcaccactgcagttgattggtatgtatggtaagtatagagcaatatgaccctcactctggtagctttctgtagagcacaattcttgatttaatataaaaataccattcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagctcaatccttttatcttttctggaactggcttatgtttcaaagaatcagcagaaaagaaaaccatagatgacaaaccacctaaaacgcctaagcacacttaactttaaacaataaagtattttttttctttttttttttctttttttttgagacggagtctcgcactgtcgcccaggctagagtgcagtggcgcgatctcggctcaccgcaagctccgcctcccgggttcacgccattctcctgcctcagcctcccgaatagctgggactacaggcgcctgccaccgctcccggctaattttttttgtatttttagaagagacggggtttcaccgtgttagccaggatggtctcgatctcctgacctcgtgatccgccggcctcggcctcccaaagtgctgggattgcaggcttgaaccaccgcgcctggctaaaagtattttttttcaattagttctttgtgggagaaggtttttcacttttgtaaaatctagaattttcagctttattaagatccacttattttccgttaaaaaaattccattattacaggattctttgaaaaccttacatctccctcaatcctgggtaaagaaatactgctgtatttattttgcagtgattgaattattcaaatctggccaaataaaaagaaactgacttagttttcaactttgagttctccaatctttaataattatttttatcccgttaagactgtgacgtcatcatggctatacctacctagaggtttaattctagattcaggttctgggttcagatcctagcttttccacttcctaccattctgtgcctgttaccttgacagttaaactggggagatgaaaagtgtagacctcatagacttgaggtgtagatcagtgagttaatccatgtaggatacttaagccagggcctgacggactataaggcttcagtaattgttagctagggccactgttctgaattggctgatagcctttttcatccagtaatgccagatgaaatgattggtttatacatgataggtgttcctaggggaaatgcagagcctacctaggatcacccacactcaagtcagtcattgatattttggcattttatacccaagagctgaaattggcttcagcccccgccttttggcatatatgtaaatcaatctttccttcccaactctgttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaagtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaagactttagagaccatctagtccagcctccttattttatatttagagaatccagaccaagaagggtaaaatgagttgcctaaatcacatagcttattggtggcaaagccaaacattgaattttggtctccctgatttcacatccagtgttttgattctttgtggtaaggatttaactctgtgtttaccactattgtcagtcacagctgcaaactttcaagtgaggaataaagtgcctaagtggtccttgccaaggagcaatagaatcacagggccactgggacttggagaaccatctgattatcgggggggttctttagatttttttaaacatataattggaacacacctagtattttaaagaatatgctcttgaaaagatgaaaagagtttctccccgggaggcggaggctgcagtgagccgcgatcgcatcactgcactccagactgggtgacagaaagagactctgtctcaaaaaaaaaaaaaaaaaaaaagggagagagagagaaagaaaacaggtcctcatgttttagtattatactgaattacttgagacacttttaacaaaagtacagaggctcagagctcaggccttgcctagacctgcaaccagaatcatgcaaggtagggcctgaattttaaggttttccaggtagtcctggtatgctttataggaaagaaccactgccgtgaagtctagcagtgtttctcaaaatggggcacctatttaaaagtcagatttctgggcctcattcccagaactactgtcctagaatttatggggatggagcccatctttaagctcccttgtgaatgttatgtccattaaaatatgaaaaaacacggtctagaatattttaagtcattaaccaaaaaagcctggggcagtggctttcaaatgtatttgttcatgccccttggtaagaattacattttacataatgatccagcaaatccacataactaaaacaaaagtttcacaaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatt

SEQ ID NO: 14503 - DNA, 17331 bp, Human
  misc_feature (1)...(17331): n = A,T,C or G
tgcctgttccccagtggctcccaaagctggtctgtgggaagtgcggctggacaggcccagggcacagcgcacgggcctggggcattcacggtgttctccttccgcctgcagggagtgaggattctttggacaccagcctgagagctcacggggtccatgccactaagcatgtgcccgagaagcggcccctgcccattcggaggaagagaagcatcggtgagtccaggaggccgcgatgggcagggcagggccgggtcggggtgagtccaggaggccgcgatgggcagggcagggccgggtggggaggagctgcccgctctcccagcgcagtggcctcaggcaagccacccgttccctcctccctaaaataggcctggccctggtgcctctggctctggcctctcccgaggcctccctccttcgagggtgtctcctgcgccagcccgcctgctcctcctggagtcctggtctgggccaagagagcttccaggagagaagagccatcataaattccttaagcgccctgtcttgtcggggcctgtccccaggagccttgccggaaacgtggtcgcgcctaatttccaattcgcagtgtgggcatcgtgctcctgcgccggctgctgaactggtggggacgcgcgtgctgtgtccggcggctgccccccggcaccctcaccacacccgtgtgccccgccccactcacacctggctccagggctccacccccgcgtccatttgggggatattttgtcccttcttacaggacagccccatggccctccagccccctgaggaggaactagcaggtttggggagttcaggggccagtccctgctttctacccaagtcccgcgtcctcgggggtcccacctgatgggtttgagccctggtgctgctcatggctctggggccctgagcaggtggacccccctctctgagctgtggtttcctccatgaagatggattttgtatcttccaccttaaagtgtcatgtgtggctggctagtcccagctgatgcaagcaggccctccccaggtgacatttgctgtggggtctgcattttgcacccttcagaccacttttgaaggctagagcatgcagcaagtgctgtaggattcactgttaaggccccctcctcccccagccactggccccacctggactaggttcccctctgcccctccagccactggccgcacctggactaagttcccctctgcccctgccacccccagtctctggccccacctggactaagttcccctctccccacccccagccactggccccacctggactaagttcccctcccctccgaccactggccccacctgtccaggtccctccagcctgcaggcaccgggctgggctcctctggatgtgtggtgctcctgcccacccagcccctgagcctctgctcccagctcagcctctgctgcctgggaggaatcctggcctgtggcttaccctggttgccccccaggcccagctggagccgcctcagccctggggtggggccgtggtcgcagaggccggtccccgctcactgtgcccccgccgttgcagaggaagctgtccccgctgtctgcaagaccaggacggtcatttacgagattcctcggagtcaggtcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccacccgagcccaagggccgcccctacctagcagccagggtccctcccgcgtccaccaccgcagcgtcaaggtgagccctgcccctcccctcccctccccacccgagcccggggccgcccctaccaagcagccagggtccctcacgcatccaacactgcagcatccaggtgagccctgccccacgcaggcctgagggtcgcccctactgggttgccagggtccctcctgggaggccacaaggtgcccctggtgtggctggtgggggtgcacggctgcgctcccatctccctggcaggtacactgaggcccagggaggagaaggagcacctgggggtgcgggaaaggcagggccggccggggcttctgctctgctgctctggcgacgagcctggcctcctttccacgccctagaccacagtgcgggggccgttttgggccttgcgaggtgtcgagctgcttagccggaagctgtctggcgtccccgggccctggagggtcctgtgcgggctcttcagtgggggccgaggtgcatggcaggaggagtagggggtggatattcagagcctgcattgccttttgaagtgcctgacctttggagggcccccccggcttcccccctaaagcagcccaggagaaggagaaggagtgcttggggtgggctcgaggccagacagcagacttccttccgtagaatcccagggtgagcccctctttctttaagttgggggtggtgcctgccttcttcaggctgctttagcagaattccatccactaggagctgattagcaacaaatgtatttctcaaagttctggaggctggaagtccaagatcagggcgccggcagactgtgtctccgctggagccgtgttttctgggttcatagatgacaccttctcgctctgccatcagtgtgaggggcgggggatgaacatgctccctaggctgctttcgaagggcactaattccattcatgaagcctctaccctagaaactaatcgggccaggcgaggtggctcacacctgcagtcccagccaccgtggaaggctgaggctggaggatcgctgagcctaggagttcaagaccagcctgggtaacatggcaggaccccatctctacaagaaatacaaaaattagccaggcgtggtggcaagtgcctgtcgtcccagctactctggaggctgaggtgggaggatcccttgagtcgggaggttgaggctgcagtgagctgtgatggcatcactgcattccagcctggacagtagagcaagactccgtctctaagaaaaaaaagagaaaaaaggacttaatggctaccttaagacaccccacctcctaacgccgtccccttcatctgggatttcagcgtaagaatcctgggggtgctggcgttcctgccacagcagggccttcctccctggggttgcgctgggggaggaacagcacccgggtgaacttgctgaaggtcttcttgcgttgctgaggccctggggctcatggctgggccccttctccctgctttcagggaagtgtgcccagagacctgcaggatgcagcgccctgggtgggctggctttggcctgtgtttgcgcctctctggcctcattttcctcacctgtgcaatgggtctgaggcagggcctggcccttctgggagagccgaggctgctgccatcttgtttgcaagggaggtttcctgcctgttggggcatcagtctcccgttttcgggatggggttgcagggtgagtgtctaaggtatcttctagcttctgtgaggcctggctggggctggcacctccctggggctcccatctgggagggatgggctctcttagggctcttctccctggaaactggcttcagttgggttaaagtgctgttgatgctcccacctgacctgcaggacccatgagtttgagcagtgggcacaggcgggtgcggcccctagtccaggaggctgttgctttgactcagagcctcctggcttggcctcagctgaggatttttttttttttttttttttttttttttgggacagcttcttgctctgttgcccaggctggagtgtggtggtgcgatcatggtttgctgcagcctcggactcccaggctgaagctatcctcccacctaagcctcctgaatgctacaggtgcatgccaccatgcctggctaatttttaaattctttgcagagtcggggatctcgctgtgttgcccagcctgctctggaccccctgggctcaagtcagctgaggatttggtgacagctgagcctgcttttcctggaatatggggtcactgaaatgatgtttgaggatttaagttttggggctacattagtaaccattctttaactttagaaaagaattatttcacacccccgccccccactgttgtgactcataggccccggagggagatggggcgggggggagaaggttctccgggaaggactttgcagccagccgggtcgtttcctcgtcacacgaccgggcactttagacccataactgggacttatcttggcctctggggacttggtcctctgaggtgctgggtattgagtaagcagattccacatcttactacccgggatctccaaggccactcactccccttttgaagccccaagatttttccagggccctgggagtgcttgtctgcggcactcttctgtcctcaggatatttaccgccggggggtcagggaaggaggggaggggagggcctaactcaggcctccaggtccaggtgtggctgggtccccctggcatgagcccccctggcatgagcccagcaccatcccctctgtcctgtgtgcctccctggggcgcagtttctgcctttcggtgggccttggcatcctccctggttatattttggaggcccttgtgagctctgagtccgggatgcctgtggtcttgttctcattagagattctcatgtcagttctgggtgctgggggaggcttggaggtacggggagaggctctcagcccatggctcagccttgtgcagcccctgcccttcccaccctggcctgtcatggggtgaggataggagggcttggccctacagggcagtgttctctccctcccccggccccctgaggaggctgggtggggtctagaggcttccagcaccctctggccagtgcagtgttgggggtgagggccagttccccgctgggagtggcccctgctttgctctgtgcagtggtagagccaggaccagggctctccctctgggtctcatctgccgggacagggtgtcctaaggcctcagggctgtgtcctgcagcagagcctggcggcccagttcccacctcctcagacccaggcccccttcatgttcccgcttctgggaggcgtcttctccctgcccacccatccgagggttggaggaaaacatccggctttggacccagggggctttggctgaggggacaaaggtcagagggaacaggaggcccattttggaggctcagccaagagaccggtcctgccgctgcggatggaggcggctgtcaacctggcgaggagatgggccccagagcctcagactctgtgcctgtgagtgggcatggatggggtcagctgaggtcaaaggggttggggctggccgggaggggcccccaaagtctgtccacccaggatgggcatggcatcccccatttccagtttttatgcctttccggtcaacattcagaggtctcttgttagaagatggatggtagtgaagctgggagtgtcactgcctggcacagaccctgctgggatcaccaggatgtgactgaccggcagccctgggggagtgactggccggggtccctagctgggtgggtgtttccttgcactctgcctggcacagttagctcttggtgcctggacgcccgactctcccccagacccaagcctcgggggtaggacaggagtgtgggcctgaacgtggaccatggggatgagatgccagcccgaggactgcaggggtctagcctggacggagctggctctgagcccaccttgctgtgctggaggcttccagaaggtgtgtgctcacctggtgcttgggatgggcctctgctccctggaacagagtggctggggtgttacgggtgagaagctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaagctccatgcaggcattcatggccgggctctgttctctctggcaggtggccaaggtggaatacgtcaggaagaagccaaaattaaaagaagtccaggtgaggttagaggagcatttggagtgcgcctgcgcgaccacaagcctgaatccggattatcgggaagaggacacgggtgagtggctgccttcgtcggcatcggtgttggagaacaggtcttcagagccttgcttttggggtgttaggtggcccccttgagcgcaacgcttactgctgtgagcatctgggctgctgttgaaggattcgttgccctgctcccgggccagatgcctgcgggggagacggatcccacacctgcaggtgtccggtggggagggtggcccaagctgcggcactggcaggagaggaggttcaggtctcactgagaggggctgggagtgcataagacacccaattcattagtgggctgcggggctgagctgagaagaatctgcagaagggcctcctgccagggtgggcgggaggagcaggttcgaggactgcagttgccctggctggctggggtctctccttcaccccgccacgcggactccacccaggagcagaatggcttctgtgccctgctatggctgggccctgggagcatgaggggactcagaagtttctcggtgccagggtgctggccttctcttctggaaagataaacaaatgccgtaggtatttgttgcttcagttcttcaccccgacggccgtccctcggcccactcaccgccctgcccttttgttaacaggaaggcctagggagtcaggtaaaaaacggaaaagaaaaaggttaaaacccacctaaagcagccaaccaggtaggactgtctgccggacacactgagtcctgcagggcggggaggtgcaactgactgatcacaccagcaaatcacgcttcctgtctcgccgggtgcggcggggatgtggccctgattggccttgatggtgtctgctgggcttgggtctccttgctccccgtccgctcctgcctcgcagaacgccctggcccgtggctcactcccgcttgggagcctgcctccagctttgtccttctctttgtcgttgattggggatgcaggagcattgcacatgaatggaacaggttgggcgacctgagcagcggtggggcagctctgagcgcctggccactctgggatcacccaccccatttgacagatgaaaaaactgaggcttaactgagattacagataaggactgttggaggctgaatatatctggaaatcctttataaacgtgcagggctgttggctactgtgttggaaattgcatttggctgctagtaacaccagacagcacagggattgagataagatcgagcttcatgactttcatctaagggtgggattgcagagcagggagggtagtcttgaggtatcatcagtgtccgccttctgtctggctagtggcatccatctgcagttgcctcatggcccagggtggctgctaaagctccagaaaccacatctgtgctccaggctggaagaaggagtgagcgggggggggggggggggggggaagggcaaaataacacccttagagagctatcctggaaatcccacccagtgacttttgtgtttttctcagctgccatccctccactgcaagggagcttgggaaatgtctcctagcaagacatgtcgcttcccagatggaggtgggacctgggcagccgccatcatcacggaggaggcagtttcaagccttcctggtccttggcattggcccgtctggcttgggaaagttggagccctgtctggcctggttccccctcctggcacgtgggactccatggtggccaaaacaaatagtttctttagaagagaggaggatctcagagatagggtgtctgagaaccctggctcctgtttgcaatgtgggacttgggcctgcgggtgaggtccattcatgaggagcctcttgggaggaaattgtccacttgggcgggtctttgaagcagtccaggactgttggtcagccttggctttgtttgctgaaagtgtggcctggtgggtggttttgtgcctgcctgtgggtcccatttctacagagcgttaggctctggcctccatgggcctgctggtgacagaccccatggtgagaggctggcactcctgttgtcccatgcctggctggtactcatgttcagcctataggcagcccacgtgttggagtgtgcgatggagaggccacatgggatgtggaagaattgttcttaagcgatcagcataggtctgcctgggtgcagactcttctgtctggctggtggcctccatcctcagggttgtctcatggcccaaggtggctgccagagctccagaaatcacatctaagccctaggctggaagaaaggaaggcagagagaagggcaaatgagccattcttggcctcagtttcccccatctgtacaatgggagaatggggcttggtctctagacatgttctgtgagatgctgtgagcctaatcccaattcctgtcagggtactgcaacatggccaatgtggcaaatgtgattctggaaatttcatgaaaacttgaaatccctgtgtgcccctgattgggttaaatgttttcaccctgttttcctcctatgcagccatgtgtgtgctgggtggttcacttggtcggtggtctcagtgtctgtctttcccttctccctgcagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttacaccataaagtgattattaagctttcctttttactctttggctagctttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacttaatattacctgttttgtatacctgagagcctgctatgttctttttttgttgatccaaaattaaaaaaaaaaataccaccaacaaaacccgtggacgtgagaagcgttttgtggtacgtttttctagcactgagtctagaccctggttgccaggtcatgcggtgctgtgttgggtggaaacggaggtcagagctttctgggtggggtccctggacctgcctccatggtggcacccgtgggatgcctgcctacctcggacttcagcacctatgggggttaggccgaggacatcctcctgcaggctccactccctggagcggatgaggagtgtcagagtagccagaagaccatgaagagtttcatccaagaagggagcccacctgacttggtgtgtccatgtgcagcactcaccataccctgcccgggctggcccctccaccacctccaggcccacgagacaaaccatcgaggttgctttcaatcttgaccccgcgttcttcgaggaccatctgtggactggcggccggctggcgtctgttgtccatgtgctgctggaatgttcttatgaaggattatcttcaacagctcatcttcatggtgctgttttcagcctcgtcagggcagcctggaggctggaggggaagtgcagggccaggtggttgcaagctggttcctgttccttggacacctgctggggccctgcctgggcctgtgggctgctgtccagatctgcaccggttacagcgccttgcccaggaatgtgcattggatgtgacgtgtggcaatgtaacatgtatttgtttccatgagatgctggcgacaatgctccatttttcttttttgtataaagtcgtctggtgtaataccgtgtccattaaagtgatggggcagaaaagccaggtggggaagagagaattccataagaattccataggtctggagcccaggggtggctgaggtagcagtagaggtgggaactcaggcctgctttctctccctacttactccttccctccctcactccctccttttctccctcattggttcatccatgcaggcgagggccctagtgccagcccctcctgtcccgacatggggagagccctggggaggggcaggcagagtggaggccactccagccaggaagggctgcagtgtggcgggggctgtggtctgaggctggatcctttccgagcctctccacccacgtgggcctgcagcctttgtcgcggctctgccctgcgttcccgggatttctgctcctgcctgggccccctcccggcccctagccctgggctgcacctggatctgggctcaggaaggtgactttctgcccagggtcagctcttcatgtcttgtgagccctgtgaccttgaccgaggggcctccatctgcatgtcggcgtgcacatctgtgaaacggagctgcagctcaggcagggtaaggacgtctcgccattgactcacctggtgcaggtcttgtctgctgcctcctcctgctgggacttcactccagcctctagtgtttctaggccccagcatggcagaggacagagcccttgggctcagggattgctgagcggcgatggtgccgcctgttaaaacgaggttcctgcacctgcctggacacctgaacgcacctgctcacaccgtgcccttgccaggggtcatgagagctggggcccagcctttgctgggcttctcctttagcttgggggtgtttccttttcttcacccaggcctctgtgtcctggctgtggagggggttggaactggctgggagagtcagtgacggcaggtggtctccagccgtgggtccctacagctgtcttgggattcccagcggtaggtgaagccgaggcctgggtctttgcctgggtccagtgcgcagagcagttgctgggctgggccaggctcggggatcccgttctgcagagaagcccttctggtttgtgccctcttgtcaagcacaagaagccacggccctcctgggacctccttggtttttttgggcttttcatacttagccatgggttcctccaagaattctaggggtgggaacttgagggcttggctcccatttt

SEQ ID NO: 14504 - DNA, 21296 bp, Human
aataaatatcgtgcctaaggataaagtggcattgtccttaatttcccccaccaaaccactaggtgtcgccttcatctcagggaaaccatgcccgtcctcgccctatacactcccaccccactccagggctccaggagcgctcttagcttgtgatttctggagaaatagcttgaaggggggagagaaaccgtggctcttagcgcgggcagagaatgggcttatgtgcatgtcctttatgacagttggagaaaaatccccaaggtcccatagcagtccctctcagccaccatgagatcatccctcacaagctgttcttggggtcagattggcactccagatatgagggccctagggagagcttcctaagggaagctgggagcaaggtggaaccccaggagagcgtggatgggcttccactgcggggagtgtcccgccggtccgttacaggctttccccaggcgccagcctgcgctgtgcaggagacaaaagaaaatcgaggccctgactgagcagatggtgcggaggaagccgggcgggctgcggtgggcctctgaggacacgaggagggcagggggcatggagacagcggggggccgagagttgagtcccaagcaagaaggagcctcgtggactttctaaggactggtgggaagtgtacagcaggggcccctggctgctggaggggcccgtccagggagcgggcatggtccgcggtggagtaagccgcactgccgtcgggagggcgctatggtttgctaggtgagggggctggtgaggataccacacgtctggggatcctcgactgcttcctggagactggaaccactgagggactcagggagttcagaggggagacccaagaagaacgggctgagcgagggggagaggacaaaccctggggtcgctggcgtgtgtgagatggaaatggaaggaggggcggcagggggaccaggggcgtgggggagaccagggtaggccctgagagtgagggagcgcccgggaaccctgctggccggcgaggccttggtgcggagcccccaagtgctcaccggggtgggtttgggacctggcggtcccgagcgcccgggtggggggtgggggaaggcagccggcgccggaggtggggccgggagggaggaggagaggcagcgggggaggggcgggggcgggcggcctgcccgggggagtcgcactcggccgccggcgcagcgagcggagacgggccgggccgaggcgacctgacccggacgagcggcgcgcgcggggcccaggcggggggcgggaggaagcgccgggcagcgccggccgccagggcccaggagaagcggagcagagaggagcggggacacgggcggggccgcagtagctccggatgggaccagcgcccgggcccgttagtccaagcaggagctccgggagaatccttcacagggagatttacccctgccttcccctgccctccggcccaggcctcgcttcgctccccgcctgcccatgatcccagtccttccgcggcgcgggcaccctcccaccttacccccttggtcctatgtggcgcagcgccctcctgccctcccggccctttcagctgtgaggttcccccaggccgtttctttgtaccacccgccccccacccccaccccatcccagtcccagatccccttttccttctcagctttagatttatcaggcttcttcacctcgcactgtccccatcctggccgcaggccccctcggtccctccctccccctgccaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcagtgagtgtggcctgggctattttagggtcatgggaggagggtcgctgtgtccctaaagctcagcactggggaactgtagatggagataggcattgagcagctgtatgtggtggttgggatcaagaagcacacgtggacagagcacctgtgagagggccaaggcttcatcatgggagcttgtgaacaccctaggcagatgcaaacaaggaagaagagagcatgaggggtgaagccttgtatcaaggtggaatgtgaaaatgaggggatattaagtttcgggagcaatgtttgtgccctagagtagtgaatgtgattgatagccactctgaaatgtgccctgtctgtgatcagagctaccacccagactgggcgccaagaccccttggtggtgtaaaaataatgagggctccatgaacggactcagggctcagcagatttgggaaagacagataaagctcatactgagaaatctgtgctgtctgtgcctttgagcccagggaagggcagggaagagtcagggagcaggccggttgggtggggagcagcaagggaggctctgggaaagggaggggcttgagagtgacagctcccttcctctggggtctggacaggctctgacttctgccagatggtccatatggccccagggtacttatggtggactccaagaggggtgggctggggagcatctgctttggggttgataggttagggcactctctttcttgctgaagagggacatcccagtgattcagagagggggctgtgtgggggacctggataccttctcagggtgctcctctgtcatgtacctgctcccagttgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcaggtatcatttgagccaaatctgaaggaggagggggaagaggtgcttcgctggaaattctctctcacaagaccctaaagaaaccctaggaaccaggcaggaattgtgagccacaggagtaaaatgaacagaggcattctgagtctagtgtcaccctttcttacttctctacttttgtgactcttagtgtgcttgctgccaagactgactttggctgcctccaaaatcctaaaacactgactttcctaagtgccagtagtaggctatattgtgggggagaaaagttcaggaagagatctgatcctagcccttgggtgggcttccaccctttatggagaggtgaggcatcgttctggtacagtcagacaaagtttgagaaaggatatgattatgtgtcctggaacagacactaagaactttagtggctcagaggaggaagagtcagtgtgggctgtgtttagggaaggcttttacacaggaagtgagaccgtattgtgactttaatgatagatgtcatattcatagtcagagtgggagaggagatccaagcatcctgagcaaagagaaaaagataggaatgggcgtgtttgagagaccaagaagatactgacccgacaagaatgaggggttcacttaaaggagatacaggaaataaagttgcaaaggtagaatcagattaaggagagctctaagtcttaaggcactaggacttgaatttggggtccttgactttttgtgtgtgtgtgtgtgtgtgtgtggagataattatacagtagtgacagaattcaggattagaagagggggagacctggggcagtgagaccaactgtaacagattagaagggggtgaggtgatatagcttgaactagtgtgatgatagcaggaatggaaagaaacgcatttcagatttcagaaaatttgtggggaatgttggcatgactctgttcatttcactcctgctcaaaactttcagtgacttgtgttctagagaataaaatcctgactccttattgtgacatttaagaccttctgcagtctgttctcaaaccactttttcagtcttacctcctggtaccctcatgctgagaactgcagcctaccaggcctctgagttcccccaaccccagggccttcctgcccctgtgcctttatgttctttttccttttgtctggaatgctcttccttccctcatcccaaatatctgcctctcaaaatcatacccatgaatcttcccgattcccccgccacttttttactaaccgtgcatataagtgtttcccgtgtatttatccatatccctccttttttccaagaaggattggaggtggcttatgggataaccttaaagtcctttaaactctgggattatttggttcgaagtagctgtgtataagggctggacctgggtggccattcttctccagtaaggttttatgtggctgtgattatatatttggttgcgactgacgagtgtgtgtctgactgagaatgacatagctgtttgcatgcctgagaatgagtctgtgactgtcacacttgaatatgggcagtggcagggcaggttttgtttatgccataatgttttcctaaaacaatcttctcacctttgtctgggtaatgcttccatattctttaagactcataccagttattttcctttctaggaaatgatcccagaatccctaagtgggactgaatttcctactcttttgcttaactccatctaccatagaactaaccatattattcagtctgtgtttgatttatttgaaggctgactcatttcattagtatttactgagcacctatcatgtccagtcactgtgctaggtactggtatacaagggagagcataacagactttgttcctgcctttttggagtttacatttggtaggatgggcaggcaataaataagtaagcaaataaatacaaatgtaggaacatattgtgatgtgttactaaaacataaagaggaaaggaatagagtgttatgaaaagagaagaacaaggggattgtacttcagctggtgtggactgcagaagatctgtgaccctctcagatgggagcactccataaccttcctggttatatcctttttctttttgagacagctctgttgcccaagttggagagcagtggtgtgatcacagctgctcactgcagtcttgacctcccaggctgaagcaatcctcccacttcagcctcccgagttgctgggactacaggcatatgacaccatgcccagataattttttattttttatagagatggggtcttatcatgttgcccaggctggtctcgaactcctgggctcaaatgatcttcttgccttggcctctcaaagtgctgggattacaggcatgagccactgcgccttgctggctgtattctatttgtggaagaaaagcctcactttcttctgtgagcattattgcccagccaagagtccccagcattaagggtagctagaggagggatctagtcatccaataatcagttatatcaattaactctcagttctccccctcactgtgggcattattcagacagagaaataaagagggaatctttgctgcaacacaagagaagggaactaggcaccaggaatatgctgatgggaaggtcaaggctttgggtaggtggggctgaggggtgataaggtgccccgccccccaccttccaatggggaagcaggggagagtctgagggaagttgggcagttagctacagccaagcaaggatgaaagagcacagagcctttctcccagagacactggccctctgaggtcccagaccaggccagcctggaaaaggtggcaatagaggaaaggaggccttgacacagatgcccacagcttttccaggagggtatcatgctcaaggaaaggccttagctcatgccgtatcgatactggctactagggagagagctctgaaatcaagtatgttgatatgatttttctctcccatttagccactagctgctccagggcagggatcatgctcatcttcatattccatatgtctagcatgtagtaggtgtttaacacatatttgctgaattgaattaggggtgtgttggggagagggggataggatgaggaattcacctagacaggagtagagctggcaagtaatgtaaactaggtgatcaaccaggatagggaagaaaagattgagtggaactaaataagcaatgaccaggctctgaggatccagaagcccaggctggtcaatggaggactacagggttagaaacccaggcagaggtcacaacctacatgaccagcatgagattgggttacacacagggagcaccagcggcaagaatggaagaaagcactaaaccaagggcttggagatcacttgtctcattaggccactgttgaccactctccagttggccagggcaagtctcagtgggcgggtccacagatagaggcaggtgcctcctgagggtgcacatttcctaggtgtgctcctggcacccacccaccactgcacccatttgtggcggactttgcttgttttttccacctggggtccactgtgaaatgggacacaattatcctccttcactttctctcaaacccctgagcaagcacagaaactgtttgaggttgggtttttttttttggtttggtttttcatttttgttttttggtactacaactacaactagtaaccacagcaaaaacagttctagcatagcagtttagggggaccatggggtcaaaactatttaaaaataatacaaagatcttatctgctttgtcacgcttgttcttttgtgattgtgtagggaagttttccagaggttacatggcatgatgatgtcatcacttggacagctatggaaggtgtgcttgtgtgttcttgcgttttcaaaatttatcagttttaatttctaagatggtcaatattgatagatatagtccacataaacaaactttatttggggtccttaataatttttaagagtataaagcgattgtgagaccaaaagtttgataactgctagcctaacaaactagccaaacttagtgttgagaattagtgtttaaaatgtgttaaaaacctatcatcagcctttattgaaatataaattgtgttgaacctgatcttttctcgcccttttcctgactttttacattgcttgtcaacaatattctacctctttattttattcttggaacaggtgctactgaatgaactatttcaaccctttcctcaattcccttctctttttaaaaaaattttacctgagactgggagaatgttagaagtgtgtaatcaggcagctaaatgctctagtaagaataatgatatcttgaggcaagctgcagtctaatataatataatgaatgcatattagaaatcgactttattatttcctatctctaatgaattgatacataataggccatatgtgatgtgtctagtgcagcgtatctctatggtccacatgtactttctatgacaagaataaacaaaactgggagaaatgaccggattttaaattatcatttcacaaagtcatgtttcataaaatatattgaactgaagtctttccttgaagttgtgatgccagtttcctgttggagcagaagttggtctcagtgactatgtggcctgaggcagggcctgagactgggaggtccagcagctcaggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaaatctctctaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctacctttcaggaggagtgccactccctcttcccagatgtatgcaacacaacacacacacacacacacacacacacacgcacacacacacgcagagagagagaggttagtagccctttcaaagccttcagactcacctgtgtatattttatatcatgtatattttaccaagtttccctgtcctgcatcttctcttcccataatgcctatcttgaatcctgttcactcttccccatatgctgctggtacagactgtattggtgatcacgtaccgagaacccccaaatcctgagtatcaggaattccagaatcgtctgctgataagagcccgggaagactttggtgtggagctgggcccttccctggtaagtagatctctcccttcctgagagtcaggtcaagctttggggaagggcttctctcccaaactcagcatcaagtcttggctgtggagcaagcccaactttggggggtctccgcttctgtccaggatttttccttctgccctatggagtagttaggaagggatggcactttaggaataagagggaagaaagcaaaccagaagagagaataggtagaagggagaccccagagagaggggaaggggccttgcaggacatttggagagtactgctgaagttgccacccccagatgaacctcatcgctggctgcttctatgatgggatcctgctatatgctgaagtcctgaatgagacaatacaggaaggaggcacccgggaggatggacttcgaattgtggaaaagatgcagggacgaagatatcacggtaatgaagaggggtcaatgggggtctgagggctgatgtcaggaatagagtgggctgaagaagaaacagatgtcaggatcaccacagctttagtgggggttagtgaatatggcagagttgcccacacctcaagatcggggaagggtagactctgagggagccgtaggcatgagtgagtgggagaggagcccagggtagacctcaaagaaaggacactcttttctgtcttaggtgtaactgggctggttgtcatggacaagaacaatgaccgagagactgactttgtcctctgggccatgggagacctggattctggggactttcaggtgatggaggaggaggcagggaagagagtgtggccctgcaaaatccagctttcaagggttcagtcggggcagaaccaaaactactagatgagggatttgttttctctgctggcactgcatcctggctgggtggtaggctggggagaaaagcagcgaaacagctggggtctggggaggaggctggtgggagcaggcctgtgggcccagctttttgcttccttacagcctgcagcccactactcgggagctgagaagcagatttggtggacgggacggcctattccctgggtgaagggggctcctccctcggacaatcccccctgtgcctttgacttggacgacccatcctgtgataaaagtgggtgtgtgcagggactgggagcagctttcctccctttgctttccattcatggcctccaccctcactgaccctccactcttaactgtgcttctgcctttacgtctgcatccctccctcctcatttcttcctactcccaaggagtctgtctatgcacctatgcaccccgttctccattctgccaagtccgcacacagtcttcctcagggtctctatttccccttcagctccactttcaaccctggcaattgtggctctgggcacaggaatcaccttcatcatgtttggtgtttccagcttcctaattttccggtgagttctgggtttcttgctgacctactccctgcccccattgccacacaacctctggctgaagccaggtggtccctataatgtgggatagggtagtaggtttcttaatttgctggttgtctcttagatccaacagcgtcttcctctctagcctttctctttagttgtcgcttagcctaggtgtttgttccacttttggtcctagactggatatactaactagtgtttttcagtggggttaagatcaaaggtgaattttccattggtcttcttttaggaaagaactttcacccccagtctctgtgtttgttagtgagcatagggcatgtgccagatatgccgagaatgcagccttatcttccagccctgtctctcaggtgtaacagttgcagcttcaggagctgcagggaagcccctgcaaccctgctgttggcttgggggtggcaggattcggcttgccagtcaactgaggtgtgcagtccttacagaaagctgatgctggagaaggagctggctagcatgttgtggcgtattcgctgggaagaactgcagtttggcaactcagagcgttatcacaaaggtgcaggcagtcgcctcacactgtcgctggtgagcccttgtctcagctgttcctctgcctccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaatcgtagatacaactaagagaaaggtcctcttatgtagtggtaagtttctgtatctaatttttaactctttcaattttcttatccttcccattgtttttttctgccagatgagagatgttcagttcaaccatctcactcgcttcattggcgcctgcatagaccctcccaacatttgcattgtcactgaatactgtcctcgtgggagtttacaggtgagggataggtgtaggagattatggcaggggtgggaaggatagacccaaagttatactgactctatgctgggtgatagctggtgggaccaggacagacagtctattccatgtcacttaccaggatattctagaaaatgacagcatcaacttggactggatgtttcgttattcactcattaatgaccttgttaaggtgagtcttccccactccttaaaagttcatccactttaaatcacttccactgttctttgattgtggtttttctccttctagtcctctgaagtcctgttctctcatctccccttattcccatggtctggtaataatgggtaaacaaggagtctggggcttataactgggacagtgagttttacctgccacaaggagtcctgtgcctgtagagagtttctatctttctgtcttaaatatctcaggtctctttccatcatctcttttacctctaagaactcataaaatgagtggagtctctgaacatatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctgaacatatttatctcttgtttttcctctcattattttactctccgaacatatttatctcctgtttttcctctcattattttactctctgaccaatatttggcatgtctgcccttttgttcagaaaactgaaatttaaaaaaggaacatttactagtagaactaagagaaaccaaggaagattgtactaaaaacctttggtactcttctgttatactaggttttagctatgttcaaatgactcagaggcccatggatttgtggagcataaaatagaatcttgcatgagttggacaggttttctgaaataagtctcatagccaatgagcatcccagtggatcaccccacactgtatctgaaactagctttggttttctgctgaattctcatgaagttatttaaaaagtatttttttgtgtgtgaaaatttgctatcaaatgagagataaaaatattagtaaagccaatgtcatgctcaactagaggtgtgatgataaacataagacacgactcttgagagaacagtgatttggtggaaaagtgatttacaacaaagccagaagcctaatcctgtgattgttgaaggcatcctttgcacagtttccacacaagtaaattcacaacttcagagattcccaaaagttttgttgataccaaaataaataaaaaggaagaattcatagagattagagttatgaattaagtccagagctaaacatttagacagaaatgttttttgttagcatattgaaccttgtatcctctttctgtctcacctgaactgacttgggtggctcctagggtttcatttttggggagcatcattaagactttttttttttttttctgagacagggtcttattctgtcacccaggctagagtgtagtggctaggtcactgctcactgcagcttcgacctcctgggctcaagtgattctcccatcttagcctcctgagtagctgggaccacagcgtgtgctgcagtgcccggctcatttttatatttttggtagaggtggggtttcgccatgttgctgaggctggtcttgaactgctgggctcaagcaatctgccagccttggcctcccaaagtgctgggattacaggcatgagccactgagcccggcctttaagactgtctttcagctcctcggaggcaaaggtttttccctctctggacccacagagccagcagttttaggcttctgcactggcttagcagattttgtccattttccaggtttatgatgttctgcactttctctctgatccagcattccctctagtagatcttgttcctcctctaccccgacttgcccacctccctctagtagatcttattcctcctctaccccgacctgcccacctccctctagtagatcttgttcttcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccagctactcttgatacctgggtctcaagtcatgtcttcctaattagtagccaggtatctgaggccaccatgggtgttatatcattttggtcttcacccaagttctgttctcttcactaatcaagaagattgactgccctctccagggtagtcatttgtagctccacttatccctctttttaagcattttccctgtccctggtggctgggtgcctgtgtcctgcttatgataccaggaacagatgactcttctgttcttcctgcttccttgggtggaaactgcaaaggatgccttccaaaatcagcttattatttttgtggacccaagatctgtagacagctagccagtgcccatctcatggagagagggtattctaagccagatatgatccaatcccatgacttgatctgtaccctgcagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccagtgaggcccacccccacaacccactttttatattgctcctctttccacctagggatggtgggagagggaggtggagtgacagtaatatagggatgagcccaggtgggcttgggggtgccccatttcgggggacctggccagccggtttcctcttttcagagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaaggtaagagtcaatccactacccacagcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccacatcagctatgctgccttcttactggctgcccatcccttcttcttaagaccctgctctaccacacccttgcttcagcaagtgtatgtaaaacagtcccaacttgagacagctcccatgcacagggattcccctcaaaaccccccgccacttgtgtgccttaccttgcattagactgtaatgtcttcccagccactttcctccctcccacctgaaaagcctagctttcttgttacagctcatctctgctgcagccacatacactttccctctctcttccactcctgctctcttggagtttggctcatacggcacccttgcttcctagttcagtggcagagcagttaaaacggggagagactgtacaggctgaggcctttgacagtgttaccatctacttcagtgacattgttggcttcacagcattgtcagcagagagcacccccatgcaggtgagagccatgggtgagaggtggcgggtggggttgggtgggtagggacctggggaagcctcattgataataggaaagatgagtttgttctagagttcccacatcttttgatggcttgtgggttaagaattcttagaaaattgggcacaagtctcagggcctctgcttttctatcccttttaggtagtgacacttcttaatgacctgtatacctgctttgatgccataattgacaactttgatgtctacaaggtgagagctgttcaatagaagaccctttaatagagacccgctttgaaactcagtctccctgaaccccacacaccttacccaccccatgatcagttttccctccagggtactcagcatcctggtgctggagtgtactttgtagacagatgtagctccagcactataattgtacactccagtcgaatttcttgtgaatcctttgacttccctaatcagaaccatcatgagatttagctcctgtcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtccttgggagtaaaaatcatctggatttgaatattggcttgttgctaactgtgtggccttaggtaagtcacagaatctccctgagcctcagttgttttatctgtaagatgggaataatagattcgttgtatggaaagtacctaacattgtttggcatgtggcagactactatttagggataactactttatccctaaatacttagtgtgtatttcctaaaaacttcactgtgtatttccttaaaacaatggcatttattctcttacatagctttggcacaattaccaaaatcaaatgcctgctttcctcctctctgacagtttgggctgtcaggtccatttcactgggcctgctttacctcctcaccagcctctgtcctcttgagttaccgttttcttgcttcccatttcctgatggcagagcctatttgtccatgtcctgctgcagacagggtgttcattcattccgcaaatgtttactgagtattcaccaggtgctgggtggagaaagaagacttaaagattccctagacatctcctctcccctagactcaggaccatggcacttattttctagtcaatattctggtctccagcatgtcaggatgattaatgatggtgtcaagcttgtctccctctactttttcccatccccatggatataaatagaggtgaccttttaatccccctctcaatcaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaaggtgatggcaggccatggggaggggggcatggaaagggagggtgaaagtgattatgggaatcatagggaaagagagggagacaaagggactaacatcgaagcatctgaatcatgtccactctcccacttccagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcatagtgtgggataggggcaatcccaaggaaaggttatggggtatgcacacagtgactcacagaatcactaaattagcagtcttgggatgagagagaaccctttatgtaaagcctcttcaagtacagtgagaattaacttcctcccgacctctctagtgcagacagaaatagattccatattccataccccacttccctcctcacccctcagaaaggagtcattctcccccctccaccacccagccttcctccgggacagggaagggaagatatttctcccaattggtaggggtaattctcaggttcatagggcaaaagtttccccagagacaagggtactggtgttgagaagctgcagttcttccggaatggtgtgtccaatgtcctgatgttactgacaccctggaggagtgccaggatgaggatggatcccactctccccaagccagaacaaaacaactctgccctacctttcctgccccgctctgcccccaacacctagtcaccctcacacaccggcagctgtggtgccctctgtatccagaaggtctcaggttgctcctggcggtagtcgtgaggctgtgagggagggtactgagtaactcctggccttcagccctctctctcaacctctgggcttggtacttggccacagcctgtcagagcccagctggtgcaagtggcgggggatggggggtgggttctcacctttgttggggcaggagtccctgcttgtgccagctccattcggtagtcatggtgtgtcacagactcaacctcgaagagcttccttgtgggttcctgttctgcctgcacctctttactatgtagcccgaggggtgtcaaggccattctcacccaatttttctcctccccatccctcttcccctttacccaatcccttaccagatctgatgctgcaggagcatctccagcatggcttcacgcttccctgtgagagagttggggggtgggcaaggtggggtctggttaagaaggaggcccagaagaaactaacttgagaaaaggaagaagaaccttggggttccgcccttatatccactggagaatccacagccccaccagaaattccttcctcttcttccctctgagtaatgggctcgttctggcctaccctctcacatttcacacctcgaagtggccaatagacgtttcctggtggctggtacgagtctttctgggtggtgctggagggcatgggtgactttagttgcatagtcagcagtccccggtgtccgtgtcggaagaaaaaactctcagagccatcctgcatgcttgggacttgatccaggtggttggtggctctctgtggatcccaagttgaatgactataatatcccttctggtacccaccctcatgtaaactactgcctcccctaagaaactgagggcagccttcaagaaaagggagcaggccaaaactttaatacctcttcctcccagttgtagaggaggcactggccccgcggcaaagtttcatagcaaaccataagcttccctttaatgtctgggggtttccatagtcctcgggcacccggttctaagacttgcaaaaattcccaaggtggttgtttctggggctcccaggggcagtgctgactccaggaggtatagttagggacccgatctgccaccaggtttctgaaccctggaggaatacaggggctgagctcagagtcagggccagtgtctggaccaggcccagaggcaggaccaggatgagagccagagccatgaccaggaccagagccaggaccagagccaggaccaggaccagagccagagccagggacagagccacagccaggaccagagccagagccagagccatggccagcacctgagctggaaccaagaacaggcccagagctagagcctggaacagggccaggattagaactatggtcagttgtagtgcaagtgtcctgagcaatacaggaaacatagacgggctcaaagcc

SEQ ID NO: 14505 - DNA, 21296 bp, Human; identical to SEQ ID NO: 14504

SEQ ID NO: 14506 - DNA, 12434 bp, Human
tgcaacctccacctcctgggttcaagcgattctcctgcctcagcctcctgagtagctgggactacaggttcgagccaccacaccaggctaatttttttgtattttgtagtagagacggggtttcactatgttggccacagacacctttttgagtgcagactagaagcttggttttggcattttacctggcatctacatcatgttcacctgtgtattggatctgaaaactgggacattctacagtttgtggaactcctgcaaatgttcctgcaattgatttactcacacactgcccacacccaccccctgtacaccacaggttcaagtatttgactcttcccaccccacccacccctgccaccagctgctctataccctcccactcactctcagggcccctgaggtccccagggagtcaccaccacataccactctctgtatctgggggaaggtctaggttgttggaaactttaatcaagcaaggacagttaacagctgcagaggcaccttaggaaacagtgagcttcaaaaaggaaatacttgtaggatctcttgtgatgacctttgacgacttttctgaaaatgacccgtcattctctgccatggaaaataacagtgatcacaggcagccttcagcccacagaaggcttcctcctccaggcaggctctgacatagccgctcacctcacagatgccctaacagactgcaaagtcctgggaacatgcatatccatgcacacacatgcacacgtgcctctctacaagtacatttttgaggtcacagctttgcctcagtggccacttcctctagggctggctgggcggagctattggcagagctctagggtccctggcagtgtcctgccacacaccaccaatcatccgagctgttggcatgtggtgaggaccttttcccccttcctttttcctccccacagctgcaggagggggattctgcggggcggatgtcactttgctaggggcgggttcttcccacccccacactacatcttgttctagctccttcctatcccggatgtaggccattttggggttcctagtaggggtcacatcccggtaaaagaacattagggagcacctttgggcacccctgctcagcagccccctttcccccaactggttccctctctcctccatcagccaggcccccaccacctatgagggcctcgcggtccctgggtcctccgccacaaatgccccctttttccttggggctgggtgggaagggacagctttgggactttttaaagaaagaactttgctaggaaagtaagagacgaaccaaaaccaaaccaagaaaatgtcaagacctccgctggtccggaatctgcgctcggcctctggctctgttctgctcctctgccttgacttcacctaggaagctgcagccttcttaagccctctgcaactcccttgctcacctgctccctggctccccatgagggtgcatggggggcagtgctgccacttgcctttccagaggtgctgcagccatggctcttccttaccttcacctctggcccaggcctgttcctgaacccccagttactggaacccccaggatgatgagaagcgagggatgcaaaccaggaacccccagtctcatggggagaacggagcctcaccctggagctggggagatcgtctgggtcagtgcagctccagctacacatcataagccccagtggacaaggcagccaggaggagggtggggcagatcagggcagataaccagaaggaccgagtttggggcccagcatggcccatatgggtttaagatgcatggagaggaagcacagggaggacatggggacaggcccatcccctacccctgtgttctggacctcagcgtcccctccgtggcccctctggccctggcccagggatgccttctgcttcattgagcccatctgtttgagacttgctaacaccttcctcttttgtgactggaagtcacagggccaattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacagggtaagggggatgaggcctccccttgatcctgcatccccacttcccgccccacagatcccattcccaaatcccaccttggtcccttttctcttctctctagacccaggggctgatgatgatggggaaatcacctacgagaatgttcaagtgcccgcagtcctaggggtgccctcaagcttggcttcttctgtactaggggacaaagcaggtctggagagcctgggggatgtgtgtttgttggggggctgtgtcttgagctggggagtccacaatgtttttgttgttgttcttgagacagggtcttgttctgtcactcaggctggagtgcagtggtgtgatcatggctcactgcagcctcgacctcctgggctcaagtgatcctcctgccctggcctcccaaagtgttgggattgcaggcgtgcgcccccatgccatggccctcagtattcttgagagcacaataccctggggaaaggaggagggcggttcttaggaaacagaagaataggaacaggataaatgggagccaggggaggaagaaagattcctcccgcaaggtggagacccctttcggggagataagggctgcggagggatagggcagccctgtgggggatgagttctaatgggaaacggggagccatgggagggaaaagaggtgatgggagatggatgagagcaaagggggagagggtttggagccgacagataaggggcctctgaggaaacgataaagggagaactaggagagatgagggggtcccgggaaaagatacagtgagacccaggaggaagccgagagagtcccgggcagaggaggaactcaggagagtgacactgtgtcccagagcagctctagcaggcaacgtagggcagactggagtttcccagtggcgagggcgaagcgggtgcgcaggaggagaaggggcaacactcggggcttccggtctcacactggatgctcccctcgacagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccgcccccctgcggatggtcccaattcacctacctgccccccttcccctctctccgtctgatatttccttccccttctcccaggtaacgcccccgagtccccaccagcactgattctggaacaccctctcccctacctgcgaaacaccccgctacccgacagaaaccaccatgcttgccccctcagctctgcaccgccctcctcttagggatgccttccccaggggtctcccccacggacctgtcccttcctctctacattctttacgggggctgactgccctcatccatcccactgtccccctaaggccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcaggtatccgctctggggagaggagagaagggagggatggattggagcaaggagatagtagtggcaggagtctatcacccaggggcctgtgaggtgttcaggaaaggggcagtgaaccagagtggtggctgacatgagctgttcagccttggccaacagagagaaggaccaagctgcatactagatttagggggacccacccagctccaaggctcatcctgtaggggagaggaggatggcagccagcagtccaaatcacactgtccaaggtttcttccggttgatatcagtgacaaggatctgggaacgcccccaaatttggatgtgaacttggcggtttgcacatctttctaaagacagggacctcatttttaattaattttcgttatagctgagatctccccaaagggtaagacttactggctgacatggagtgcaacctggtggtggggcaaggcagtgaggcgctcagcactcacagtgaggtggagctgggagttgtggtgtagggaactaggatggggtgtccattcattttgaaagcaggaccccagccagtaagtggagatggggaaagggacacataaaagaggcaaggctgtatcaaaacaggctgagggtctaggcaaggtgccacgcctaaggggactggggtgtttttgggctatgatcaggtttaggctctgtctagcttgggggtcatctgggtgatctccccaggcataagacagcaagattatgtgcagacaccccttgccctcatttccttaaccttaccctctgtgaccatcagttccatgccagggctgctcttagcagcatgttagacctctacctcccaaattgctcttccggcgaaaggatggtttcagacttccactctgatcacagctgcccaccactcctgcaggttttccccacacttttttgatctcatcaaggcctccaatctgctgactcccctttttctcccttcccatcagtccaggcctccaatcaactgattcccctttttctctcttcccatcagcttctcctgtccacacttctctccctacctaacatgggtttggagcccatcacttcaactactcacttatttttttaaatagagacaaggtctcactatgtttccctggccggtatcgaactcctggactcaagcgatcctcctgcctcagcctcccaaagtgctgagattacagtcgtgagccaccgcacctggctcactcacttctttgttccattatccttctagtgtacctgatgggcaaaatttgaactctggatgaacccaactgcccatggtcagcatcaaggtgtgacaaattgtggaatcattctgctcagtgccactgagactctagtctctcagcactgcctggcaacctttgcaatggtcagcttgctctccatagtaactccttctccctcactttcagcagatgtcctcatcttccactctttcagagaggaattcccttcactttccatcaccaagtctatatatccatatggatttttgcccatcctcatcttttgcaaggatatctgcaacagctttctaaatgtttttcctactcactcctctccctgcagtccattcttcatattggagccagggtaatcttttacaaacaaaaatctgatcgtgtcacccaatctacagcattccagttaattgattacataaacagttatggaatacataacatataatatgttctagcactgtgcccaggcacttgggatatagctagtgaacaaaattcctctatgtaaaaccctacactgactttctcttcctcataatataaaaataaaaatccttaacatggcttccatcactcctgcctacctttcagtgtgccacttatctcctcaccctcttccatttggccatacagatttctttttttttttttttgaggcggagtctcgctctgtgagactgaagtgcactcccaggctggagtgcagtggtgtgatctgggctcactgcaacctctgcctcctggattcaagctatccttttgcctcagcctcccgagtaactgggattataggcatgcgccatggtgcctgggtattttttggtatttttagtagaggtggggtttcaccatgttgaccaggctggtcttaaactcctgacttcaggtgatccaccccgcctcggcctcccaaagtgctgggattacagaagtgagccattgtgcccagcagggatttctttttattcctttaagttgccataggacagtagctcaagggagtagcagggtggggacatgagcatatgtagagagaagagagggagctagtggagagggaatgatttttgagtgatgaaggtaggactgatggaacaaagcaatggagagaggtggcctgggatcagaagtgcacattgggatgtaggatgttgaagaaagagggatatttatttcttatggatagtcaggaaaagaagaacagagaagagaaattttgaggtggagaggagggaaaaggagagagctcagtttctgcaaaacagtacacaacattttctgcttgtaggaaattggagagggacggagggggccagtgctggaggagtggaggatgtgcagtgaggggtgctttagggagtggaggagatgggcccaagagatgttaggtaaagtgtcagggtggactgcaattgttcagaaattggggtaataaaatcagccctattaagacagacctcccagattgctaagaagtaatgttgttgaatgttaaagtctttttactaagtaaggacaggtatggtgtttccaggggatgcaaaagaaagattgcaaagatcatagaagtccatgaaggtgctgagattagctctgggggaatattgttagcaaaagattgctgagtagtcactttcatcccaactgttgctgctatcacactctttctgctttttagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcagtaagcatatccttactcacagactgcagtgggtactattaggtaaagggacatatgtcatcaagtcaggaatggcagtgcacacatggctggggtggccattccttttccatggaagaaactgagaatcataatactcttgacctctgagcttggaaacaacctctgcatcttctcagcacagtggtccaggcagcccctagtaactgattagagttggcatgagaatggaaacttaaccatatctacatttttttttttttgagacagagtctcactctgtcacccaggctggagtgcacttgcataatctcagctcactgcaacctccgcctcctgggttcatgcaattctcccgtctcagcctcctgagtagctgggactacagtcacatgccaccacgcccagctaatttttgtatttttaatagagtcggggtttcaccatattggtcaggctggtctctaactcctggcctcaggtgatccacctgcttcagtctcccaaagtgctgggattataggtgtgaaccactgcgcccggcctctactttaatgtgtatctcatctcagcttgctggtcagctccctgggctgcttgacaggttcctggactcttgtggcctctcaggcagagaggtcccacacctggtgggctggattgtagggattagttccttggggccagaacagcacacagaatgactcccctccaaaggctggcagagattcttactcagctggaaggcaaatttagcagtgagcctgcatctgcagggtggcacttgatggattcagggacaagttaccaaagagctgtcatatatacagcccccttgccaaagctgaggcctccctagggtgtgcattttcttccatatttctcatcactctccatgtatctctggtctctctgaatctcccctcagcactcttactacttcttaaattcactgttgccaaatggtggttcagggaattcatattggactggcctcagctctaacaaggattggaagttgactgatgatacacaacgcactaggtaagtttgttaggacttctgggtattttcaactccataatcccctccataaagacatggtaatcagatttccttcccacctggtcccctcaggactctcccataaatcaacactgtaattgcctatttgtctgtttcctctatttgattaataacttcttagggcaatcttattctccattctatttccacctagaagtccctggcacatacttttttgtttcagtaactactaggttgggacctacgctatcttttagggggagacattaaggatttagttaaggctccacagctgatgacagcagcgtttctccatccttcgagaaggccacccaaactgaggttgtactttctcagtagcggccacttggggcactagagctgcctcagtgaagtacgcaagggagcagcgggggtaccatcgaagctccacttcactgtgatcaagacagcagtggggtaccattgaggatcaaccctagggaccctgaaacagggtggcaacctccttatgttcctcaattggccttcccatcttttttttttttttgagatggagtctcgctctgtcgcccagactggagtgcagtggtgcaatctcagctcactgcaagctccgcctcaggggttcacaccattctcctgcctcagcctccccagcagctgggactacaggcgcacaccgccatgcccggctaattttttgtatttttagtagagacggggtttcaccgtgttagtcaggatggtctcgatgtcctgaccttgtgatccacccgccttggcctcccaaagtgctgggattgcaggcatgagccaccgtgcccagcctggccttcccatctttaagatctcgagttatttttccctctgctggttctaaagcctgttttagttgaactccagacatctgtcctgaaccatgcccagatgtggccttaggcaggcagggtgagttaggatttaggttttatacaggggaaggggagagaagggagggtgggatatgtccagagcatatcccagctctaccttactactttttaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttggtaagagtgagggatggggctgaggcatggggagtccaggggcagagggactcagagcagggactcagagcaggggcccaggggcccgagagaaaacttgtacctgggatgaaagttcctccacagcctccagttgcttggtctgcttgttagggtggggtgggcagggagggacaggtaaggcctacaacttatgggaggctggtggtgtggctgtcgagagctgaggaggagatggggtgagtgggatgagggttcagttaagtcaaccatggagctcactgatactttacttttccagacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaatgctgtgtctggttcagtgatccccacgggaacgcgagccggggggtcgactggaagtgctctgtcccttgagtccatgctggggctcccctacacggggagaagagccggtcagcccatctggaactggcactgtccagcaagtgtgctctgttcttacagggtgtcctgaaggccaaagttggaggcctgagaccacgggctccactgctaagagcgtgccccaggcagctgcaggctgggtgtgggtggcttggcgtggtgccctcggtggcagaggagactgcccgcctcacagttcaggttgcggtagcgggcaacagctggtgtggggcgggggcacatggacaggaagccaaagctgaaggggccgaggcagcagccaggacagggcagcccctcatcgggctcccggggagctgaagggggtggcgagggttctgtccgctccagggctgccgcccggggcaggctatgctgggcccggttccagggctccccagcccagccttgtggggagttcaccaccacagctgggggattgttattgaggacgggtcctgatctaggggaccagggttgggaggccgaggaacaggtgctgatgaagttgtctgtggccacagccagaggcagctggggcgctggccctggaggttccggctcagggctgctgccctcgcactccatcttctcttcagccgaggggcccacagcgggagggccaggacctggcagtgctgtctccatacggcgggggagctcgggggatgagggtagtgagcggcagcggcgggcaggtgtcccaggctggaccagggtctccggagtggtcaccaagggcagctgagtggatgggaatggtgatggtggcacaagaggcaggactggcttgctgggtgtgtctaagagcttgatcttgccacccctgaggtcttcccgtagtgagaaggggttgactcgagtcagattgtccccccagttggggggtgattctggtgatgggggcaggaagaggtctgaccggcttcgggaaagccggggatctggcctgggaagcgtggcagagggaccccctcttgcaacagagcctgtagatagagaagtctggaatcactgtcctcagcatttgatcacagctccttgagggcctcactattctccaggaggctggtgggactagagcttgaaaaagggagtcccacctggtgctttggaaaggggtgatgtcatctccaggccccttttacttctttcccctcctctccctcaagctttagcattaggaaactgtcttcttggagatgtcctcccaccctaccccagcccgacccccagccttttcaactaataaatatacttagcctcccccatgtcacctctgaattctagggaggacaaaggccaaaggactcaagctggatcaaggtcaggctcccttaccctgattgtgtgtcagggcggtcctggtgagtggggctggctcaggcagctgctccaggatccattccaggtgctgggtaatttcggtgaagggggcacgggtgctgggttccagctgatgggtagagacaggaacggcttcactcagtgctccgaaagagggtctctgagtttcctcccatcacctgggtcccacagggcagccatggcagcttacggatgggggcagggtggggcaggaaggagtgtgaggctcttacgttgcagcagtggatggccaggagcaagaaaggcagtgggcagtcatcccccaccagagttcggaaagcaggcacatccaggccaaagtcctgtggggacagaaggagggacctccaagtcagcttttcttgggttctccttctgctccccagtcagaacctcaacctctagggaatcctccttggttatgagccagctagtctggaattctttctttgcaaacctagaaacattcacctcagtgcgtggtaggtagtcagggtctgcaggt

SEQ ID NO: 14507 - DNA, 7180 bp, Human
cacacctgtatcctaacatttgaggagctgacacaggaggaacacttgcagccaggactttgagaccagctaggataatatagtgagacactcgtctctacatttctttttaattagctgggcatggtggcacttgcctgcagtcctagctactctgaagactgaggtaggagggtcccttgagcccaggaatttgaggctgcagtgagccatgatcatgtgactgcacttcatcctggatgacagagggagactctgtctctaaaaataaatcaatgaatacaataaatgggtgctgtttaaagccaatgtttgtgacaatttgttacccagtcttataaaattcatacacagactcaaaagactcctggaatgaactgatgaattgatacgcacactagttacataaaataaaatcttttttaactttttcagtgttttacattttataattttctgtgatgcaatttaatacactcataattcattcattcagccaagaaaaaataatttagtccctacaatgaaccaggtatgccctcatatgctcaagtgcctgacattctagaagcttcacaagaatgaggtggagccactggagtgttttaggtggagaaatgacacactctgactcatagtagcaggaccactatagagagaacactcatgtagcaggtcatggaacagtgctagagccacagttcaggagtgagagggtggtggggattaaggggagaagagggcctgagggatgagagggacggagggaagggctggaggagcaggaggtgaggaaaaggagcagaggaaagaattccaaagcagcagaactcttaggtttaaacacattgttttatagattttaatacatccatctacagagcctcgctgggtgttctttgcagttggcctttaatatcttatgtgggtctgcctagaaactaattgttttttatgttaatcaggtttaaaaaatactaagtattcctaaaaaatatacactccactcacatgtggatacttcctaaaaacaggcagtgcgtgagcactagtgaggggcattgtgactgcactgaacacttacaactgtgaggtgaataaagtttgtgctggctcctggttgcaacatatagtaacatagtgtggtactttgtcttgaggagatgtcctggactcacacggaaacttagggctacggaatgaaggtaaatttaaaataaaacaagcgggagtcacagatacactgtctgggaaagtgaaacttaagagctttgtgagtcctgttgtaatgcttttagatgcatttatataccaacgggccaaagtcacattttttaccgattagattcctgatcattcaggggttaccaaggttatgctacccactatagttaataaacaaaaagcaaactggtctctattctatctcatgcactcaggcacaacttttccagatttaagggggaaaaaaaaccctgtctttacacctacaatcccagggcgagctcactctctggcaacaagctccctggggtgatttttcttctagaagagtacaggaggacaggcaaggagtgggaggcagggagtccagttcagggacagggattccgggatgaaaagtgaagggagagggccagggaccttgccgagggtttctccctggtttctcagacagctcctgggccaagactcagggagacactgagacagaacgcttggcacaagagtagcggggtcagggcgaagtcccagggcctcaagcgtggctctcagggtctcaggccccacaggcggtgtatgggttggggaggccccgcgttggggattctctcctccttctcctaacctgtgtcgggtccttcttcctggatactcaccgggcggccccagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggtgagtgcggggtcaggagggaaacggcccctgcgcggaggagggaggggccggcccggcgggggcgcaggactcggcagccgcgccgggaggagggtcgggcgggtctcaacccctcctcgcccccaggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagtgagtaactccggcccagggagcagatcacgacccccacctccatgccccacggacggcccgggtactcccgagtctccgggtctgggatccaccccgaggccgcgggacccgcccagaccctctacctgggagaaccccaaggcgcctttaccaaaatccccgcgggtgggtccgggcgagggcgaggctcggtgggcggggctgaccgagggggtggggccaggttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctcccagcctggcctagcacaaggagaggaggaaaatgggaccaacactagaatatcgccctccctctggtcctgagggagaggaatcctcctgggtttccagatcctgtaccagagagtgattctgagggcccgtcctgctctctgggacaattaagggatgaagtctctgagggagtggaggggaagacaatccctggaagactgatcaggggttccctttgaccccacagcagccttggcaccaggacttttcccctcaggccttgttctctgcctcacactcaatgtgtgtgggagtctgactccagctcctctgagtcccttggcctccactcaggtcagaaccggaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgagagatgcaaagtgcttgagttttctgactcttcctttcagacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagtaaggagggagatggaggcatcatgtctgttagggaaagcaggagcctctctgaagacctttaacagggtcggtggtgaggcctgggggtcagagaccctcaccttcacctcctttcccagagcagtcttccctgcccaccatccccatcatgggtatcgttgctggtctggttgtccttgcagctgtagtcactggagctgcggtcgctgctgtgctgtggaggaagaagagctcaggtaaggaaggggtgacaagtggggtctgagttttcttgtcccactgggggtttcaagccccaggtagaagtgtgccctgcctggttactgggaagcaccatccacactcatgggcctacccagcctgggccctgtgtgccagcaccttctcttttgtaaagcacctgtgacaatgaaggacagatttatcaccttgatgattgtagtgatggggacctgatcctagtaatcacaggtcaggggaaggtccctggctaaggacagaccttaggagggcagttggtcgaggacccacatctgctttccttgtttttcctgatcccgccctgagtctgcagtcacacatttctggaaacttctcgagggtccaagactaggaggttcctctaggacctcatggccctgccacctttctggcctctcacaggacgttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacagtggacatagctgtgctatgaggtttctttgacttgaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttactttttcaaattatttccaagagagattgatgggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagtagaaccttgtcccaccaggacctgtgatcacatagacttggatatcacctagggtggtccctacacttagaagttcctgtgttatcagaagaaaaattttcagacccctacacctcttcccctccttccaggtctctttcaattgtattttccatctttttttttttttttttttttttttttttttttgagatggagtctcactcaggctggagtgcagtggtgcaatctcgactcattgcaacctccacctcccgggttcaagcaatcctcctgtcttagcctccctagtaactgggagtacaggcacatgccacgatacccagctaattttttgtatttttagtaaagacgggatttcaccatgttagccaggatggtcttgatctcctgaccttgtgatctgcccgcctctgcctcccaaagtgctgggattacaggtgtaagccaccatgcctggcttccccaaccttcttaaaggaagcagattctgaaacttcccgagaggagaggtcccagagtttttcattgtagtttactttctgttggaactcctcttctgctctctctcctactcttcttcctgccctgagttgtagtaatcctattgctggctccaaaccaaactcatggatttgtaaagcagagtctaatttagattcatatgtggttggataattggagccataagccttgggttatctttcctcaagagacaaatatggttgtgtgctgcagtgtgcaggaggattggtgtgggaggagggagggagggaggacacaaaagcagccctggtgagaaaagcactggtgcatttatatccacatgagataatattgttccacagcggctacaaaatgacatttggcctgagtctacattaataaagatattgcctttagaataggggggcgcactacagtaatcatccattcaagtggcatttgttgtctgctaggtatttgactgtttttgcatttagaaaacatcgttaaagtaaaaacagaaaaatttctggccttgtcgtgtatacattctagatgcaagcttgtccaacctgcagctctcgggatgcatgtggcccaggacagctttagaatgtgacgatttttttgcttatctgtagtggcagatatcatgaaaattatccatgcattttttttcttttttctatttttttctgctcatcagctgtcattagtgtattttttgtgtggctcaagacaattcttcttcctatgtgacccagggaagccaaaagattggacacctctgcaggcagatgatatagtataagcagagtaggaacagaaaatgcttgagttagaaggtggcaagtgctgtgtggcaggtgatccagagggtgggctgtgggtacagggaggtggctgttgtgctgggtggtcagcatgggccttgttgcaaatgtgaccttggagtaaagatttgagggatgtgaggagttgtctacacggatgtctcagaaagttcttttcaggcagggaaaccttcagtgcagatgcactagggcaggaaattgtctgtgttcctggaaggaggaagaggccagaagtgttgaacagagagaaactgaaatgaagtcagaggtgtgcccagagcaggttgccctggagggtgtgggaaggatgttgacctttgctctgaatgacatggggagttagaggacagttttggaaagtgggacatggtaggacttatcctttgaaagcttctctctggctgctg

SEQ ID NO: 14508 - DNA, 7971 bp, Human
  misc_feature (1)...(7971): n = A,T,C or G
cagcctgaccaacatggtgaaaccccacctctactaaaaatacaaaaattagctgggcgtggtggcatgcacctataatcccagctactcgggaggctgagacaggagaatcgcttgaacccaggaggcggaggttgcagtgagcccagattgcgccactgcactccagcctgggtgacagagtgggactccatctcacaaaaaaaaaaaaaaagaagcagcagcagcagaactgaccagctgtgagatcagaaggcaccaggtatttcttttggtccaggtctcctatccgagctttgggagccttttctactatcaccggcacccggtccgggtatttctttccagtcttcttgctctcggagccgcccgtttcttgaacggatgctcttctttgtacatgaatttcatcctgttgggaacccggctgaactaggctgggctgaaggaacctgggggagccgggaggtgggtggcagtgatagtggcgacaagtaggcagattcagccaatgtagagcattttttcgtgtgtttattggctatttgtatatcttctttgctatgatgtcttttcaaattctttgctttttttttttagtcgtaggcgttttttaatatattttggatgcaggctccctttgtgatacatggtttgaaaatattctcccatttgggggattgtcttctcacttgatggcattatttgcagcacaacaattttaaattttgttgtagtccagttttgatctgttcttgtagtgttttaatggtattgatataatttgttttcaaactctattctaacccattgagatctcattactagagaaaggaaggttttttgtttttgtttttttttgtgtgtgtgaagtattcaatcataagattcttaggacacacttatacggatttggccagagtttctgccctaaagaattcttcctaatagaaaggtgttttgaaattgtatgaggaaaatacctttatgagagagcattccttgctgctcctttgcctaaaccaatggttatctaccgggatgactttgacccctgggggaatatttggcagtgtctggagatatttttgatggtctcaatggggcaggcggtgctactggcatctagtgggtagaggccgggtatgctgttagacaaactgcagtgtacaggacagcttcccacaacaaagaattatctggcccccaaaaccaataatgccaaaattgagaaactctggcctaaacagggagatcctgaaacttaagatattaaaatatttttcttcaatccatgccttgataatcacataaagattgctaatcaaaggagaatctttgcagatggaatcactgtggacagaacagtgacagaaaagagaacactttgctgaattcaaaatgctgccaatttgtatgtaaatgacatttatggtgatggaaaccagttggagcaaaagtagattattccctacacctcagtccctgggccaccctgagatagacacaaacacatacactcacaggcagataaccaaaccgggttgatttagacagatgctggaatggtggtctcctgagagaatacagcaatgagattttaggattcaaatttaacaacagtgattgacagtcactagtgattgacaatcattgttttttcctataatttagggaactagctttatcctccttgcaagttgcttgttgcttaagacatttcttaagcagcgtggcatccttaagagtttggattctgggtccagattgcctgggcttagatcttagcttcaccgtttacttgtgtgatgttgtacaagttccttaaccctcttatgaatcagttttttcttacgtaaaatgaggatgcagtagtatctaccttatagaaatgtggggatgaattaatacatttagagcacttaaaacagtgcatgacatacagtgttaaataggtgttggctgttaatattatcacatatcttatctatattctttcagctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaaggtagtacacatcctgatcttatactatacagagaacctccagacaagaacgattccttcttggctgggcacagtggctcacgcctgtaatcccagcactttgggaggccaaggagggtggatcacctgaggtcaggagttcaagaccagcctaaccgatgtggtgaaaccctgtctctaccaaaaatacaaaaaaaacgttagctgggcgtggtggtgggcacctgtaatcccagctactcaggaggctgaggcaggagaatcgtttgaacccgggaggcggaggttgtagtgagccaagattgtgccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagactgcagttcagggagtttttaatctgcacagatatttggttgagagtggtaagcaattaaaatccttcagtttttatgtaacatattagttcagttgttaataagacatttaaatgttcttgccttaacttctccataatagtagggactgtgtttggtatggctagatgaatttaggtgattttgaaagttttaagtaagtgatgtctacttttaaaatggagaacctcattaccagctttttcctttttttttttttttttttttttttaagacagactcttgctctgtcaccaggctggagtgcagtggtgtgatcttggctcactgcaacctccgcctcccgggttcaagggattcacctgcctcggcctcctgagtagctgggactacaggcgcacgccaccatgccctgcaaattttttctgttttagtggagatggggtttcaccatgttggccaggctggtctcaatctcctgacctcgtgatccgccctcctcggccttccaaagtgctgggattacaggcatgagccactgtgcctggccgatgccagctttttcatgaactatgggatataagtttataagaaaggataaaaatgcttttttttttaacctacagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccagttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgttctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttagtagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaattttaagtagttattatcacctttatccctcttagtttgtaaaaataatttttgagttttgtcatgataatatttcagacttggagatatttggagtggaggatagggcaatatttaggtttgggttatttgtgtgctgtttcaaggataaaacatcctggtaagtcagtcagtgaatatttttgctttgtgtattgcagacacccatcatactgactccaagccccttgctctccagtatccacttctggagtactctcagtcctgttgctcccctaagtccagccagactgcaaggtgctaacacacttttccaggtaattttataaatatctgtcttctgtagttggagcatgttaaatgaagaaagaggcaaaaaggcagggtcccactattcagtttaatcattataaaacttctatttaatgaatattctttttttatttttttgagatggagtcctcaccatgtcacccaggctggagtgcagtggcataatctcagctcactgcaacctgcaccttccaggttcaagcgattctcctgcctcagcctccggagtagctaagattacaggtgtgcaacaccacgtctggttgatttttgtgtttttagtgagacagggtttgaccatgttgtccagactggtctccaactcctgacctcaggtgatccgcccaccttggcctcccaaagtgttgggattacaggcatgagccattgtgccctgcccaatgaatattctttagatttatttttgaatttccaaatattaattttctagctggcaaacagcttgaataaatatagcaaagtttcattttcattatttactattacatacatttgagttagaccaagaattgttcaatactgtaggagatttagagcctaccccaagtttttgtcactagaaattctctatttaaaaaaaaaaaatgggccaggcagtgtgtgtgtcatgcctgtaatcccagcgctttggtaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacataggttccctcttttaattaaagattaaaaaaaatttttttttgaggcggagttttgctcttgttgtccaggccagaatgcaatggcacgatctcagctcactgcaacctctgcctcctgggttcaagcggttctcctgcctcagcctcccgagtagccaggattataggcatgtgccaccatgctaggctaattttgtatttttagtagagacgaggtttcttcatgttgatcaggctggtctcaaactcctgacctcaggtgatccgcccgcctcagcctcccgaagtgctgggattacaggcatgagccactgcacgcggcccaagcatttttttttttttaatagagaaaggtcttgaaaatggtatatcaaacagtcccatttctccctcagtcagaattgataatttatcaacattttatatgtacattttaaaaaaaatgaatattatctcttcaccaagacgttaggaaagttcttgccattcctaatgggtttagccattattttgcccaaaacacttagatgttataacttaaagactttcttggagtcaattcatttacttattcatggttgactatctctgattttcttatattttgtaatttaacttctcattcttttagaaatgaaatggtagggaaaaagaggaaaattaaaaatctctctgctttttattttttgccaacgtttaaaattattgaatagaaaaaaaagttgagaatttttcatattttttttcattgcc

SEQ ID NO: 14509 - DNA, 16367 bp, Human
  misc_feature (1)...(16367): n = A,T,C or G
tctgagttaacggtataacattttattcatgttattaactttatatagataccattgtattttattttgcttgagaatggtctcactttgttgcacaggctggaatgcagtggcataatcctagctctctgcagccttgacatcctgggcccaagcgatcttcccatcttagcctactgagtagctgggactacaggcatgcaccaccatgcctggctaattttattttttattattattattattatttttgtaacggtggaccttgccatgttgcccaagctatagatagcattttagttttttatttttatactttttttttttttttttgagacagggtcttgctctgtcatccaggctgtagtgcagtggcatgatcacagctcatggcagcctcaacctcctgggctcaaatgattcccccatctcagcctcctgagtagctgggactacaggtgcatgccaccataaccaactaattttttattttttgtagagatggagtcttattatgttgcccaggctggccgtgaactcctgtgctcaagtgatcctcccacctcagcctcccaaagtattgggattacaggagtaagccaccgcacctgacctagatgtcattttaaatcagtcttatttttccatttacagagctgtgcatgtgggttattaaaattcaaacagtgcagaggcaaagcatacacatctcgatttggtcccaattcttcatatttgtatttatcccaggggccagatagtaaatattttagcagttgctggctggctctgttatctgttgcgatgattcagtcccgccaccataggacaggagcagccctgagtgatatgtaaatgaagaggcgtggctttttggggttaaccaggtggcaggtggatttagccaggaaaagggtggtttgctcacccctggtctatgttaattgatatgtttattaggggtttttttgtttgttttttaatggaaatgggcttgacccacacctgctgctctgtatcttggggttttcccctcacttaatgacacaccttggacccctccaggccgggcacatagagctgcttgacagtccctagactgtcacagcttggcgccatcccactgcttgacagaccatagttagccgttgccctttgtagcaacactgggaactttcctcctttcccgtcttctttgtgactcagtggtgaacacctttcaactgcttgttgctgtgggagggctggaggcccgtcaccccagggcacacactccatggagaattctctttgggcccccttgctgtgttaaatatttctgagttcgttgccaacatttaaaaatcagggttgccaggcgcagtggctcacacctgtaatcccagcactttgggaggccgaggtgggtggatcacctgaggtcaggagtttgagaccagcttggccaatgtagcgaaaccccatctctactaaaaaaaaatacaaaaaatttagccaggcatggtggtgcatgcctataatcccagctactcgggaggctgaggcaagagaatcacttgaacctgggaagcagaggttgcagtgagccaggattgcgccactgcactccaacctgggcgacagagtgggactccatctcaaaaataaaataaataggtgaagaactccaggacagttagctgggctgcatgaaggtcatggccccccgtctctggagtgacctagggtggtcctgcactctgggaggggagcctgtaggacgtggtgccagccccagatcccagcacctcccaggtgcccccacagaagggcatcagtggagaagcctgtccacccatggtcagcacccagggggctgcagagagtgcagatcttggggtctgcctctgccctctgggaggtttggacccccaggctggaggccagctctccaccctccctcagcctcccacctcccagtggctgccttgggtggaggggctgaccggtgactgtccctccagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggtagctctgccgagtgggccgtgtggccgggctggccctgcctgccccacccgctgacccagccctccccaccccgcaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggtgagcccatgcgtggcctgcggcatccaggctgctctgtccatggggagcacttcctctgtgaaactcctcagtcatccgcaagcccccctcccccagtggcatcagatggtgtttgccaggtgtctgtgcatgtgtggggctcaactgaacgtccccccaggcaagctcaacgtggcaggataaccaagtggcgtggggcattgggcatcagtttgttcattctttgaacaaatatttcccagtgtcatttgtgaactccccagaccctacccttgggggcaaataggcaaccctgccctgtgccccagaaccccggggggcctcgagggcagaggactgacctccctcctccccacaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtgaggccgctgaggccctctgcactctgggctcccaacgccctggatagggcctgggtgggagtcggggagctgacatttgggcgcaccttgagcctgccgagccaggcctttgggtcaccgccagagcatcccctggtagggctggccctctctgagagcacaaggaggggctccgtcttgggaggtggaggtggggcaggaaaaaccagcaggaagccctcccctctcccaaggcctaggacaggcagtgggcagcttggggggtcctgggaatcctggtgtccagggagtggttggggccgccccaccagccgctcaccctgcaccccgtctcagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaaggtgagatggcgccttccgcctcccctctgagccaccccttctttccacctggcgtccaactccatgtgctactggccatgggtccaggggcccttggtatggagagctggggctttgagctggggaagccaacacagctgaccagcgtcctgggctgggggcctgtgggactgccgtgggtggggggcagccccatgcctggctcaccggctgcccttcccctctgcagagctcaggggtgttggggccccctggggagcccgcatggcaggttttctgggaaaggagatagcattgtggacaggcccaaacctggccgcaaacctgtgaccctctcacccgcccccaagtggtcacgggcctcaccataggccagggagacaagctgcactttgagccgtgttaacagccctgcttccccggcccccagccttcctctgtgtccctgtggtccctggagcagccgttccgcatcgagctcatccagggcagcaaagtgaacgccgacgagcggatgaaggtggggctcctgggataggtgggagagacactgtttttttgcacaaacaaggtggctgtatcctggaggggtagcagaggaaggagggggatcacatgaaagccacctgaccacattacccagcatccctgcctggggcgctgtgagcggcttgaaaacaggaagtggggagggggtgggccagccggccctggaggctgattcgtagaaacttgggccaagcagcgttctgggtatttgactttggtggaggttatggggccaggttcagcccagggatccgggaccgcagagctgggggaagggccgggcatggaagaggggctgggtccagctgggctgggggctgtggtgctccctggaggcaccagggcggtgcctgcagcctgtgagggctgcacctgcctcaacctctaggggctgagcccacctccctgttgtctcttaacactttcacacgctccatcgcaacagcctgcagtcatgggctttattgtcctgtttgctggacatgatacctgagtcctcagaggttggccctcctgcctggagtgtgtttcactggggaaatcgtataagcagggcaggtctgggttccactggcaggaatcgagggggactggatcagagggacttccagggtggtggtgtcaggtggaattggaaggggccggacatcaggtggcaggaaaagtccttccccacccacatgggctcataggaatctgagaagtccagggagccctaggatgttagagcaagggtccctgaagttcttgatccctgatggggaaactgaggcctggagtggggaatggacatgccccgaggtccccagagttggggtagctgagacagggcacccatgcacagcccgtggtaccctcccctcaccccagggccgctcatgcccctcaggccttccctgtgctgcaccaccttccttcgtgtgggaagtagagttcagacccacctgaggacattcaagggggagactgacaccttaagggggaggggagaggggctgggcctctgcctcctcacccatcatcccggcaccttctacagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggtgggtcccagggccggctgggaggggtgcagaccccggagagccagtacagccccttgctgggccactcaccactctcctcccggcaagcacgcagcctggggatgggggtcctgggattgcttgtggaccccagcctcctcacccaccctagtctggccaccagccctgctcgagggacactctgggctcctgggctcctgtgcatgcggcctcagaatatctggcctgggctgtggtcctgcaggaacctgcaggtagtgccctgggatggaaggacaagcacagtgtcatccctggagcagaaaagcctgagtcagcggctggccgggaggcgtagtggctgggtgctgagtcacggtcccaggatatggctcccctcggagctgactcactccgagctgagctgggctggcctctggggctgggctgtctgtttggggatttctcaagaagccaggagggccaggcgtggtggctcatgcctgtaatcccagcactttgggaggccaaggtggtcggcttacaaggtcaggagtttgagaccagcctggccaatatggtgaaaccctgtctctactgaaaatacaaaaaaattagccgggcgtggaggcacatgcctgtaatctcagctacttgggaggctgaggcaggataattgcttgaaccaaggaggcagaggttgcaatgagccgagatcgtgccactgcactccagcctgggtgacagagcaagactccgtctcaaaaaaaaaaaaaaagcctgagtaggggtgaggtgggaacaggagggtgcagcaggtgtcagctggcttcaccactggagccctcagaggaaagaggaaaaagcggctcctctccttccccaagcagggtctcccaggggtctggttgggagatgttagctgggctctgggtcttctcgggtggggtgcctgggggagggcagggaagctgggtctggaggcccctgagtggctgtcctcacctgccctgtccttctgcaggactgccccattgcctgggccaacctcatgctgtttgactacaaggaccagcttaagaccggggaacgctgcctctacatgtggccctccgtcccaggtcggcccaggcccaggagggagaggcgttgggagtgtgagggtcccagagatgctggtcacccctctacaacttcatctgcccctgtgttcagatgagaagggcgagctgctgaaccccacgggcactgtgcgcagtaaccccaacacggatagcgccgctgccctgctcatctgcctgcccgaggtggccccgcaccccgtgtactaccccgccctggagaaggtcagtgggggccccgccgcgtgaggctgaggggctggcgcggagctctcctggccctgctcctggagctcttcagagggtgctccctggccacgtcggggctgggctaccaggcatatctggggccttcccaggggccattttgcctgcagggatgctgcgcagtctgatgacattttcggttgtcacagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggaggtgagtggggtgggggtgtggggtggggggcatggagccggcgtggaaccagagccctcactcctgcccacacccctcagcagctgcagctgcgggaaatacctggagcggcgggggtgctggggagctgtatgagcacgagaaggacctggtgtggaagctgcggcatgaagtccaggagcacttcccggaggcgctagcccggctgctgctggtcaccaagtggaacaagtcatgaggatgtggcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggccaaccttcaccctgaccctggccacccaccaccctgaccctggctggccatcacccttaccctgaccacctccaccctgaccccggccgcccccaagcctgacctcggctccccccagatgctctacctgctgtgctcctggccggagctgcccgtcctgagcgccctggagctgctagacttcagcttccccgattgccacgtaggctccttcgccatcaagtcgctgcggaaactgacgtgagtcccagctgggcgctccccacttctccagagggcagctgtgtcctggctgccaggacgtgggctctgggtggggcctgaaccttcccgtgggcttgctccgtcctgcctggcctccctctggctgccgagggagctccctcctgtcctgagtcggggagctccaggccccagcgccttccttccctgcagggacgatgagctgttccagtacctgctgcagctggtgcaggtgctcaagtacgagtcctacctggactgcgagctgaccaaattcctgctggaccgggccctggccaaccgcaagatcggccacttccttttctggcacctccggtagcgggacttgccccagccgttctgtgggaatcccagcccctgagtctccctggaaggccactggggacgtttccagcaggcctgggtgtcctggcctcgctaggtcctgctgggcgggaggggctgcgtggtgctgcctggtgaggctcagccctcccttcaccttccagctccgagatgcacgtgccgtcggtggccctgcgcttcggcctcatcctggaggcctactgcaggggcagcacccaccacatgaaggtgctgatgaagcaggtgaggcccaaggcctggggggcgggcagggggcggccctgagcgtctgggaatccccagggctgggtcgaggctgggacctgcccaccgccgccctcccatctgcccaccagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctggtgagcccaagccccgccacaagggttcctcccacccctgggaggccggtagaggagcccctgctgactgcccgctctctggcctggcagcgtggagcagtgcaccttcatggactccaagatgaagcccctgtggatcatgtacagcaacgaggaggcaggcagcggcggcagcgtgggcatcatctttaagaacggggatggtgagggcctggcctccccacaccccgcctgtactgccctggggggtcctggggtgctcctagagtgggggtggagaagacagaatcctgggacttaagggcttgggtgtagctggaagcagagaacctaccagaaactcatgcttctcctcccaccggccggtggcacagacctccggcaggacatgctgaccctgcagatgatccagctcatggacgtcctgtggaagcaggaggggctggacctgaggtgaggacccccaccccacatcgtcccttggtgtctgtgcccagcctgggagtctgtgcccctggaggggtccttgttgaaggtggcatgaccatctcagccggggaaagggctttcctaggaagacccggaggcggtttaactctaggccaggaggcggcgggcagcaggatgcgtgaaggctgctcctgaggcttagtgtgtaccctgctctgttgctttagttgcccaggtgcccctggcttccccagcccatcttgggaagcagtggcgtcttctcccaaggcctctgtctggttctcttccaagcaaatgtgaactcagctgtggtgctttctgcacctcagatgctggtgccggcatctccaaggagccagcatctctcacctgctttttagcaatgtgggcagcagcatcttctgtggctttttggggcaccatgagtttctggggctcaagtggcctcagggacagcccttgaccatgccatttgcccgtccctcttcccccttgcctaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccggggtgggtttcaggcccagggataggttccctctcctttccaagaggtgtggagtgggagggcctcgcctgtcagaacaaaggagcggggaggggcctcagaccatctttgtggctacttggctcagttgaggaccagcctgtgtctgggttggggtgaggtaggtctctcttccccaagtatcagtgtctcttgctatgcaacaccatccaaagcgcagggctttaaaaaacagccatttacgattggctcacagatctgcagctggggctgggctcagccgggtggcttttctgctggttccacataatcactcatgcagctgttctcatctggtgccttaactgggccagtggggtctgagataacccatctcattcctggggccttggcgccagctgtctgtgatgcctctctgcatgtggtctcctcatttagcagcctcaccttccttccgtggctctgtattgagggtatggggttcaagatctgcaggggtcttcatgccttggctctggaatagcgtctgcaagcgatgtccagcattgtgtcctccatgttctgttggtcaaagcaagtcacagggccagattcaaggggagagggagtaataacccacctcttgataggcggagctgcaaaatggtatggccatgctttttaatcttccccacccagggaggccctggatcgagccattgaggagttcaccctctcctgtgctggctattgtgtggccacatatgtgctgggcattggcgatcggcacagcgacaacatcatgatccgagagagtgggcaggtacaggggctggtgctggcggctgctgtggggacttggcttctggccccagcctgctggcccctctgcctagcacacagctctgtggcaggggtcccccagccctgctggcttcctgtctcccctggattctctcctgtctgacaccttctcaatcctccccctcctctcccctcccctcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggtgagagtgcctgagccccaccagatgcccctcggtgtggggccccagggaacagggcagaggttcccaggcagggtgcaggatggggctcaggtctcaaccccacacctggcccctcaccccaactgttgatgggtttggaacatgcccctgctccaccctgcagtgccccttttgggcaatgtgggcaggtttgtgggtcatgtagcaggaggctggctggggcacgggggtcagttagcagaactggaggccttgtgtccacccattatcagggcaagggcaggtgtccttggggaaggggctggttggatgcagagcggccctctggcctgtggctgggagttcccagagcctcacttcctctgtcccctacctgcaggttccggggctactgtgaaagggcctacaccatcctgcggcgccacgggcttctcttcctccacctctttgccctgatgcgggcggcaggcctgcctgagctcagctgctccaaagacatccagtatctcaaggtatgtgccgggcaggagactgctgtcgccagtggacttccaaggcctgcccccgagcaatgtgacctaggagggccctgaatgcagtaggccccaaagggcactgagctgtgtgtgcctcatgccgtcccaggacccagcagtggagctggtgggcggtggaggggaaagtggctggaccagagttgagccgcccaggcatggttccactcagtggcagatgtgtagtgacctctcctggttggggtgctgtgctcagggctgcggggctttcaggtgtccactagggggccgcgtgagcgctggctccctctgccttctaaaagatattttttggccaggctgggtggctcacgcctgtaatctcagcactttgggaggccgaggtgggcggatcacctgaggtcgggagttcaacaccagcctgaccaacatggagaaaccccgtctctactaaaaatacaaaattagctgggcatggtggtgcattcctgtaatcccagctactttcgggaggctgaggcaggagaatcgtttgaacccaggaggcggaggttgcagtgagccgagattgtgccattgcactccagcctgggcagcaggagcaaaactcggtctcaaaaaaaataaaaataaataataaaaaaagatatttttccaggccgggtgcggtggctcacgcctgtaatcccagcactttggggggctgaggtgggcagatcacgaggtcaggagttcgagatcagcctgaccaacatggtgaaaccctgtctctactaaaaatacaaaaattagtcaggtgtggtggcacgcacctgtaatcccagctactcaggagactcaggcagaagaatcacttgaacctgggaggcagaagttgcagtgagccgagatcatgccactgcactctagcctgggcaacaaaggcaaaactccgtctcaaaaaataataataaaataaaaataaacataaataaaagatatttttccaggctgggcatggtggctcatgcctccgtaatcccagcactttgggaggctgaggcaggtggatcacctgaggtcaggagtttgagaccagcctggccaacatggtgaaaccacatctctacttaaaatacaaaaaatcagccaggcatggtggcacatgcctgtaatcccagctactcatgaggctgaggcagaagaatcacttgaacacgagagactgaggctgcagtaagcctagatcgcgccactgcactccagctcgggtgacagagcaagactctgtctcaaaaagaaaaaattggccgggcacgatggctcaggcctgtaaacccagcactttgggaggccaaggcgggtgaatcatgaggtcaggagatcgagaccatcctggctaacacggtgaaaccccgtctctactaaaaaatacaaaaaattagccaggtgtggtggcggctgcctgtagtcccagctacttgggaggctgaggcagaagaatcacttgaacctgggaggcggaggttgcagtgagccgagatcatgcccctgcactccagcctgggcgacagagtgagactgtctcaaaaaaatgtatatatacagatacatatgtattttttttccttcttgtgtcctctccatgtgagaaggtgggatggggcggtgaggctgctggggccacacatgcttgccaggaccttccctctggtgaccagtccctgcaaaagcagctgctcccatgctcctcccagagccatttctccagtaggggaggcgaggtcacttgggaactgggggctctggggccaagatgtctttggcaccttcatttgagggtgggagcggaatagagagcttttcctgagatgctgggagctctctactaaccatttcattcagtgactctgaagtccccagagagggacgcatcccagagcaaggtccgggcccccttaacgtggacaccgctgtgatttgtttgcaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgcctcgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagctaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgacagcgtgaggacatcccctgggcgtgagcgtctgtccgctgtctaaacagagcagctacagggacgggacatggaggatggccacacatagcacagccaccagtgtcctcagaactagcagtcagggtcacagaacagtattcaaaatgattgcccacctgttttagaaatctaaaattttacatgtaactaagagcaaagtgctatgtgggttttagaccatgactgtttgtttgctctcctgccctaccaccaagcaaagcagcagggctcctgggggagagggatttcaacccccctgatggcagggggtgctctggggaggagagaggagagaacaggctgttttggaaaattccagcactttgacttcgggccatgcgtctctcctggacgttctgagtacggatcgctcaggcctcctgccgtctccaaaaggagtggtcagccggtctgcaggacacctctcag

SEQ ID NO: 14510 - DNA, 7846 bp, Human
  misc_feature (1)...(7846): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtcacatattaattacctgtgaagttgttgtttttttttttttgagacagggtcttgctctgtcacccaagctggcagtgcagtggtgtgatctctgcttactgcagcctcgacctcctgggctccagccattctcccacctcagcaccccctccccgaatagctgcaactacaggcatgcatcaccacacccagctaatttttgtatttttttgtagagaaggggtttcaccatgttgcccaggttggtctggaactcctgagctcaagccatctgcctgtcctggcctcccaaagtgctggggagccaccacacccggcctacctgtggagtttataattatatatataaatgcctagccgctgcttcagacccactgactcagattccataggggtggggctaagatatctatattgtattcaaagctccacttgttatgatggtacacaaccagttctgaaaacctctggtttgctcgttaagaacattgactttggaatcagacaagcccgctattaaatctcggttctatcacttagttaccatttgtcctggactactgttcattttcattgctataaaataattgtcccattttaaatatttttagctctaaaacctgaaaaagtgaaattagctgcctgtggaaggaaccacaccctggtgtcaacaggtatagtgctcaacctgtatgatttcctgcctgactttgagaactgaggtctcattccagtaacgtggctttgtaaaattaatagagattatactttggcaacagtaaaattagggttttttaaaatgtcaatggctagtacacgtttgcctttgcaaatatacacgtaaatgtcaaatggctgaagaaaaagcttcttttcttggattctatcatgggacagcatctcctaacctgtgtgtccaccttaagggctggttattcctgttcttgctcttctctcttccttactaagggtgagtggaaggcacccagaaggctgttgatgtgagtgagcataattcccatcaaaatccatatgagcttttgtgtgtgtgtgtgtgtgtttgtagaaattaacaaagtgcttctgaaatttatatggaaaagcaaatgacgtagaagagccaaaacaattttgaaaaataacagaggactggcactacctggtttcaagactcgctgtaaagctactgtaatcaagactgaggtattggcaaaaagatagacaaagattaatgaaacagaatagagtctacaattagacccatatgtatatgcccacttgatttttggcaaagatgccaaggaaattcaatagagaaaggatagtatcttcagcaaatgctgctgtaacatttagacctccaggacctgaccactgagcagtacttcctccaccttccccctgcccctgccccttgccccgcccctcccccaccaccacttattctgtcttcaggatgttttcactgcctcagctcctctccacctctccatacctttccctttctgaagtgtctttttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaacaaaaaataaaaataacaataactttaaaatttttactaactcaggctgattttgccctcatttcaccttataatttagcaaggctttaacttcatttatatatttatgacataactaatttatgtgttacaaatcttcattaatttacaacttactggaaatgtttataatctaggcatgatgtactttttatttaattaacagagtaattaacaaacatttttacatactttaaatgagccaaatgctgttctaagaattttacaaatctcaactaattcaatcttcataacaactctatgaagtaggtactattattatcctcattttatagatgaggaaaatgaggcacacagaggttatggcttgcccaaggtcccacagctttggtaagtggtaagccagaatttgtacccaagcagtctggctctggagtctttcctgctaaacagagtgctatagtgccttcctatttagctaggaagttaaaataaatacaaagaattatcatgtttctaattagattcttcttggatttgccttgttttacttatttgtactattatatcttagctttaatggttacagaagttaaaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaattcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctggttagctgctttgtttcaagcaggagactgtgtaacatccggtgttactctatcaggaaagtcagagttgtctctgaggctcagtcctttagattttgtcagcccttaagttagcattttgacatccttctttcagttcttattttcatttatttgttttgcattattaaaatacttcaaaaatgtaaattatttaaaatatataaataaataagtcttaataattcctttctaaaatatttttcctagattaactttttctgacatcaaaacccttatcagaaattatatgttacctatttttgagatgctgtacatgctattgtatcttcattctctgaggctagattctgtgttttcaggtttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaacctgttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatacatttactctttattccatataccacaggctcagggttagaaagtggtaattcacccatttcactgccccctaaagttaccaatgaattggtagcagcatgataccaagagagagtaaacctgactttgtcagtatttttcaccactgcatccctggtgtcttgaacaaactgataatcaataaatattattgaatgagggagaaagtgaataaatgatgaattgattgcattccttgaggcaacactacctaccaacttattggcaacttttggctcctggggttggtatagtctgtactcgctttgttcatgaaacaaaaacacaaatgggaaaataagccaaccaaacaacaaaaataccaagtaaaagcattgtatcatatttgggctttaagaaaactgcctgaatgaattgtgtgaatgaactctgcattagccgttaggtgaacaagtggaatagttcatcttaaccaacaggcattacattgagcttttttttggtttgtttttatgccctttttttaattaaaaaaagctcagctttattgagatataattcacataccctacaattcacccatttaaggtgtacaatggaatgtcttttagcatattcacaggtttgtacataaaatgaacttttatactaagcattttgctgagattcatttacatcagctgatatgaactgtcagtaattttcacactagccattattttatgactttaatcacttaaagcaactttttataaattttggaaataactcaagtataaggggttttacttaatatgtatttcatgatagaggaaaatgttgtatagaaaagcattatttttttctctttgtatgttgaatttgtagatcagaaaaaatggattatttttaatttttaatatttgtgggtacataatatatatatagtgggtactacagatatatgtttagtgggtactctctctctctctctctctctctctatatatatatatatatatgtatatatatggaatacctgagatgtttttatacaggcatgtgatgggcaataatcacatcatggagaatggggtatccatcccctcaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14511 - DNA, 35574 bp, Human; identical to SEQ ID NO: 11843

SEQ ID NO: 14512 - DNA, 14244 bp, Human
  misc_feature (1)...(14244): n = A,T,C or G
cttgtgattcagtgctctcttttgtgaaatagagcaaataacagtactacctcacagttgtgaagatcaagtgtattaatatatggtaaacactcagaacacttctgggcacatagtagtcagtattttcaagcaaaagaaactcaacttggcttggtatggtggtcaggcctataattccagcactttgggaggctgaggtgggtggattgcttgagctcaggacttcgagaccagcttgggcaaaatagtgaaaccctgtctttacaaaaaatgcaaaaattagctggacgtggtggtgtgtacctatagtcccagctatttgggaggctgaggtgggaggatggcttcagcccaggaggcagaggtcacagtgagctgagatcgtgccactccactccagcctgggcgacagagctagaccctgtctcaaagaaaagaaaaaaaagaaaaaaaaaaagagaagaaactcaacttgacaatacaaaagaaatgtgtatcggatctcctaactgcaaaccttcagagatagagcaggtcagacctctcaaggtttccctacagttttcttattcagatttctaggactcacatcccttagttcagaagaacagaggctgctttcctacctccaaccagtaaacaaaaggcagaggctgtccaactggatgaatttaggtcatgtgcctgcccctgaaccattctcagtagctgagagaatgccacacagtgattggtttaggggtgaactctggctttacgatgaatgaggctggcattaatgcctgcaaaaatggacaaacttgctgtttgaatttatttatagtaagaaataaaccatgaaaacttttctaaaatgtaatcttttagaacacaaaaaaattgcagaaacaaaaatggcccagaatcctgatgctctgttgaccatctttgttttgtttgttcgtttgagcatatggcaaaaaatgcaaaattcagaaatgtgtaatgagcatagaatgttactataacaattgaaaaaacttgaacacacactacatactaaacaacagcatgaaatttcagtttttctgaatttgatgactgcagtgtggttatataagagaatgtcttttcttaggagagacaccgtgaaacagaggaaaaaggacatgattctgaaactttctcttaaagtaacatattaaaatcacacatatgtacacgcgtgcatatgtatacatatatatgtatagagaaagcaatagcaaatgtggcaaaatgttaagatttggcaaatctggataaagatttgcaattctgctgcatttgaaattatttaaaaataaaaaacttgagtttttggagaaacaggcataagaaaccttttgtttccatatttgcggcttctatacagtcttttatgatgcaattaaaaaaaaactaaactaaaaaatataacacaaatcttccctcccatagtagccagaaacccccgccgagtactttgggtgtcataataggaaaaaaatgcaaagcaatatgtttttctataaagattacttatttactaattagaatttttttattttcatgaagatcaacaacaaagtttttaaaataatgacttagagaatcattttgtggtatttgtttaaggctgtcgcccaggaaaacgcccaaggaccatgcacgcttcaaccctatggaaacacgaacggcccagggaaccgccccttcgcgctgcttgacgggatctggagtcctcccgctccgccccgccaggcgctcagggaccgcccggccgctccctcaccgcccggccgctccctcatctcgcgatgccatcctctttttttttttttttctttcccccctcccactcgcccccaagccctgtgactccctcccctcccaacgtgtttttcaaatccaccaatgggcacacagcttaggctcgaaccagccaatcggaatgcggagtcaccgggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcaggtacagactcaggcggcggcccggcccgagcgctaacggcttgcccgtgggcggcgttcgccttttgggttgggggagggaggccccgggtccacgccgagcctggctctgcctcccgcgttgactaggcctcgggggcgacgttcattgaccaggcggctgagtttcgcggggtctgcgggtttagggcgccgacgctctgcaaacggcagcggaggccttaacgcgtcgcggccgggagaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataacacgttgaaatactatttggatatgttgggttaagtaaaatacattattaaaattagtttcacttgtttcttttctcctttttaaaaatatggctactaggaagtttcaatttatatagcttgcattctatttctgatggagagccctctccaggaagtctcagccctttagagggaagggggacacttcccctttgggtaaagctatttcatagtgccgaaaacatgatgatcccccctctagtatacaggtgtggattcagtagatgcttgataattcagttcttatttggtactattattgacaaaggaaaatgataaaggaaatatttttctcttcccccatcttttagctttctccctttgtctcataaccatgtccaccaacgagaatgctaatacaccagctgcccgtcttcacagattcaagaacaagggaaaagacagtacagtgagtaccttctgttgctttcctgtggtggtatttaaatgggaagacatttggaaaggggtgaaaactgaggtatttaaaaaaaaaatgccctcacttagcaacaaaaactggtgtgataggtgaaacggcatgttatcttttctcaaggaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccaggtaaaaaatgtattttagtttatgagttacgtgaaatccagaaaatcagtagggacttttcttagaaattcaagtaaacttaacatttctagtcttaacggttttaactatctgtgaacatctttttctctgtttgcaattagtaattgtcttctttcctgccttctgtaatccactgaagctgatttaggatcttcctttagctctgaccttccttcagacttccctgcatttctagctactagctgggtaccttggcctgaccagtgtgtccagagccagccagtttctggtttatttcttcttttttttttttttcccccgagatggagtcttgctctgttgctcaggctggagtgcagcagcacaatcagctcactgcaacctctgcctcatgggttcaagcaattctcctgccacagcctcctgagtagctgggattatgggtgcgcatcaccacgcttggctagtttttgtatttttttgtttttgtttctttgagacagagttttgctctgtcgcccaggctagcgtgcagtggtgcgatctccgctcactgcaagctccatctcccgggttcacgccattctcctgcctcagcctcctaagtagctgggactacaggcgcccgcaccctgtctggctaattttttgtatttttagtagagacggtgtttcaacatgttagccaggatggtctcgatctcctgacctcgtgatccacccgcctcagcctcccaaagtgctgggattacaggcgtgagccactgcccggcctgtttttgtatttttagtagaggcggggtttcaccatgttggccaggctagtcttgaactcatgacctcgtgatatgcctgccttggtctccagaagtgctgggattacaagcgtgagccaccaggcccttcccgtttttggtttatttctgccttttttggtattctctatgtttttgtatttgtcaccagctttgttcaggactttccttctgaaatatttacagtagcctcctaatttatcatatccttctttatgccatatactattttcctgaaatttttcctgaagtactgctttagacctgtgttttcgctccttaaaatccatactccaaattgcttgaacctgggaggtggaggttgcagtgagccaagatcatgccattgcactccagcctgtgcaacaagagtgaaactccgtctcaaggaaaaaaataaaaataaaataaatccatactccagctgggcatggtggttcatgcctgtaattccaacactttgggaagctgaaatgggaggatcactggaggccaggagtttgagcccagcctaggcaacataggaagacctcgtctctataaaaagtaaagttagctgggtgtggtggcgccggcctttagtcctaggtattcagggggctgagacagaagaatcacttgagcccgggattttgaggctgcagtgagctgtgattgcaccactgcaccccatgctgggtgacagtgagaccctgtctctaagaaatccctactctatgaaggccttccataaagtagacttaacttagattttcaaatttatctttcatctgggccctttcctacatgtttttctcacaatatgcttccttttttttttgttttgagacaaaaccttggtttgttgcccaggctggagtgcagtggtacgatcttggctgactgcagcctccgtctcctgggttcaagtgactctcctgcctcagcctcccaagtagctgggatcacaggggatcaccacgatgtctagctaatttttgcgtttttagtagacacggggattcaccgtgtttcccagtctggtctcgaactcctgacctcaggtgatccacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggagaaactccatctctactaaaaatacaaaattagctgggcatcgtggcgcatgcctgtaatcccagctactcaggaggctgtggcaggagaatcgcttgaacccgggaggtggaggcggtggtgagctgagatctcgccattgcactccagcctgggcaagaagagcaaaactctgtctccaaaaaaaaaagtcgggcatggtagctcatgcctgtaattccagcactttgggaggctgaggcaggtggatcacctgaggttggcagttcgagaccagcctgaccaacatggagaaaccccgtctctactaaaaatacaaaaaaaaaaaattagccaggcatggtggcgcatgcctataatctcaggtacttgggaggctgaggcaggagaattgcttgaacccaggaggcggaggtggtggtgagccaagatcatgccactgcactccagcctggggattgagtgaaactccgtctcaaaaaaaaaaagaaaagaaaatcctcagaacgttgcctatgacttcatgtctttctccctcaaagtatatctgaatgcaagtgattgagactaacgtagaaataatcttcagtctgctctgattcttgatttttgagacaaggtcttgtatggcgacaggcaaacaccaccatgcctggatattttttttttttttttttttttgttgggaggtctcactgtgttgctcaggctggtctcacctgagctcaagccatcctccctcctgagcctcccaaagtgctaggcttacaggtgtgagccaccatgcctgtccttctcgttcattttttaaaattgttcaaagctgccttttttagcgacaaaacacttggatactccataacttgagactccagtgagtccatgacaacaagtttggaaactgttctacatataaaataatgaatatttaacaggcaaaattaaatgtagggctaaatatttagtagctggctataagcctaacgatgtttacacttgccttcacaagtaagtgtggattttattgtttgtatttaatcttaatgataatgtgcaaactttcacttttcttctagggcactgtaaattggtctgttgatgacattgtcaaaggcataaatagcagcaatgtggaaaatcagctccaagctactcaagctgccaggtaagtcttgtctgcgatagcatgggtagcctaagaaatttgtgtttttagatttttttttgggggggtggggcaggaagggacagacagatagtacaaggaaagattaggccagccagccataagccaaatagtattttttatttattaatttttttgagaggggaggccttgctattttgcccaggctggcctggaatgcctgggttcaagcagtcctctgacctcagcctcctgaagtgctgggatcacaggtgtgtgccattgcacctgcccataaagtttttaccaaagtaatgtttcaagtcactggcaggggaaggaagaaataaatagtaagtgggattgagacatgcatttagaatgatatatccatttaggagataagtataatttgacctttacctcccactatacgtggatatttatgatataatagaaaggattaataagttctatagcttgacagtgtgcagaagaaaaatttcaatggtaaattatcattaaaaagttctaggctgggcgctgtggctcatgcctgtaatcccagcactttgggaggccaaggggtcggttacttgagcccaggagtttgagaccagcctgggcaacatggtgagagccagtttctacaaaagaaattattagctgggtgtggtggcacatgcctgtaatctcacgtgtttgggaggctcaggcacaataatcacttgaacccagcaggcggaggttgcagtgagctgagatcttgccactgcattccagcatggcgacagagcaagactctgtctcaaaaaataaataaataaaataacttgggtgtggcggtgcacacttgtcgtcccagctactaaggaggctgaggtgggaggatcacttgagcccaggaggtcgaggctgcagtgagctgtgatcgtggcactgcactctagcctgagtggagtgagatcctatttcaaaaaaacaaaatgtgcttaaccacaactatcagaacaaattcagtgagagtataaccctgtcagaatgtgaaaagtttttttaaaaagtgacaagatctggagtagatttctgcagggatggaaaggagggtaatctacattaatttctggaaaaatggtagttaattataccgcatacatagcaccatacaagtaatctgttcagcttctcttaggttccagaatgtctcagcatttagtgatttacttaaaaggttgtctgaagttctaaactcttgaattgcattttatattggtttttacacaaactccttttgttaatcactgtcaacttttatttgtctttttgttcccctttaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtacttggacttgaagttcttttgactgaatgtatctaatcgtaattagttggaagaaaggccttgttataagtaatagtgactttgtcaagttttgagcttgctttcaagcccttattaggaatgaaagtgtcgtctttacaaaggcagcagagggccatctaagtaagtttgggagtttttgctggtgcattcagtcactgaaaattgatggtgttggacaaggtaataaaattaatcttgcctcggccgggcatggtggctcacgcctgtaatcccagcactttgggaggcagaggcgggtggatcatgaggtcaggagnnnnnnnnnnnnnnnnnnnngtcaggagattgagacctcctggctaacacagtgaaaccccacctctactaaaaatacaaaaaattagccgggcgtggtggcgggcgcctgaggctgaggcaggagaatggcttgaacccaggaggcggagcttgcagtgagccgagatcgcgccactgcactccagcctgggcgacagagagaaactccgtctcaaaaaaaaaaaaaaaaaattaatcttgccttttttttcaggtgatggctcagtgttccgagacttggttattaagtacggtgcagttgacccactgttggctctccttgcagttcctgatatgtcatctttagcagtaagttactaacatgagtaaagttactcacttcttcattctaatttcccccatcttctcaaaagacagaacctctcattgcctattttttttcccccagtgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcaagaccagcctggccaacattgtgaaagcccatctctactaaaaatacaaggaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaagcataatcagttgatagtaatattgaaatattgcctatttcaggccatgatgggcctcttgttaaaacttttagggtatagaatttctaaagtgctggggaaaaaataaccagcatcaacatattttttttttttcagactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggtaacgaagtcttaggatttaatcaagtcatttttagtatttatagaaagctgtgcttgataagcttcttcacgtgcaagaatcttgggttctactaggagtcctttgctgaacaatacccagtaaccccttttacttaaggttggatagaaccttggtactttcagtcattgtttttgtgaaaaagtactcttggaatcttatttgtgcaactgttctgaaataaaaccatttccttatgtttaataggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggtaagtcctatcaaggtggctttgtttgaatttggacttgataataatcagtttactatttagacttgggggagggcagctgtaagtttactcactagtaagccacagaatcagaaagcctgtttatgtggccacccctttgattaaaaatgaggcaggcattataaaagatacaaaagagacgacaagtggatggtgtgacctgaatcggagtcaggcgcttatgtggactcatcacacctgtttacttggttgatttaatttcccaatttcataccgatttttggtgacattaaatttgaatgacttggccaggcacggtggctcatgcctgtaatcacagcactttggaagtccgaggtgggtggatcacctgaggtcaagagttcgagaccagcctggccaacatggcgaaaccctgtctctgctaaaaatgcaagaattagccatgtgtggtggtgggcgcctataatcccagctactcagaaggctgaggcaggagaatcgcttgaacccgggaagcggaagttgcagtgagccaagtttgtgttattgcactccagcttgggcaagagtgaaactgtcttaaaaaaaaaaaaaaaaaaagttgagccttcaataatggatgctagcgtatctgttactgtgtataaataatttgtcagtatgtggccagtatttcttcttcccctcatctaatcccctaagttattttgaagcaaatctgtttttttcatctatagatatttatgtatctctttaaggttgaaaatttaaaggaaaactaacctaccataccattccatatgtccagtaaatccttaatacccaacacacattctgtttggggacgtttagtttagcactccataggccatctttgcccttagacaccttgactacaccttgtgatgacataggatgctttacgaaacaatacacccctgttcccatagcagaccagttgaactggaatgtagtgttgttttaaaagttgcccgcatgattttgatacatagaaaaggttgggagctactactgattgtaagatctttggctccagttgaagtagtgctaaaagcaggtacagatccaatcacattgagtgtcaacaaaatataaaatggacataaaactatgataggcttgatgaaggaattgttaggtgcttatttctgcctgacgtatcaatattcaaattattgatgttttcttcattaaaataaaaccagagtatatgccagtaaacttggattttttttttttttaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggtgagtaatggatggtaatattaataacaacttggaaacataaagtcaaggccataagcctttttttcccttttaaaaataagtgtcatatctttgttaaatatagtaaaatatcagtgtgcatgggacataatgtacttatttgcccctctagtttggcttgatggtaataaaatctttttaaactgagattttaaaagtcaccagattagtttcaaatgaacaaccttgagaatcttagaatatcttgagggtaagttaacgggtgtcattgtaggaggtgatagagaagtaggccaaactcatcaccatgctctgggcctaatacagtcttttcctattgaaaagtgacggttggggaagaaaaaaatctcggcctgtttgtgttactgtagtagctagcatttatgaattggcaaagtttcagagaccctccctcctctatgtcaaatactataatatcatacaggattaaaggtgtaatatgcagatcaagacctagagattaaatacagacttcaggtaggctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctgcagtttttgcagaagtaatgaataacattttctggaaaccctcagccagtgtctccttaagtctccttggccagggagatgggctaaataccgtaaatttaatcataaatctctgctggagctacaaatggaattctttcctcccaaacttcaaggccgaatggggttccaaggtaaatcacggctgcacatgggcctcatctgggaaagtacccagttctgtttcgttgatgaggggcatgagggtccaccatgtgtcttttttaaaaatgtaattcccaagggctcctgtacagtgtaggttgatagccactactctttgagatggtgtctcgctctgtcacccaggcgaaaccctgtctctagtaaaaatacaaaaattagctgggattacaggcatggtggtgggagcctgtaatcccagctactcaggaggctgaggcaggagaatcgcttgaactccggaggtggaggttgcagtgagctgagattgcgccactgcactccagccttggtgacaagagcgagactcttgtctaaaaaaaaatcccctttgataatatatctttacctataactttaatttttgtatttgtttttgttgtaagcaagggaggaaaggtaatattcctaataccatttggcaattatagtaaaaactgctgacacttactttgcttgttgaaataatctgaaaagagtaacattaaaagatgtcagtgttaaacatttcacaaagtattctttcattgctatattgcattttggctaaaaataatcaggctacttgattatttttagaacaaaggaaatcaacattctgtttcctaatgttgattttttttttctctcatcaatctggctgcatcatcactgaagaaaaaacggggtaatttttcgttactgtaaatccttattgttaagattttttatttcagcatttggctgctttaattgcataacagcagtaagagcaaagtcagttttgttcataggagccattggaaaccttgtcagatacaggacccaagttcagaaggccattaaggcctggctgctccttacccct

SEQ ID NO: 14513 - DNA, 143173 bp, Human
taccttttaacttctctgtatctcttaaaatagaggaagtaatagtacctacttggttatcaggtggtgcggatgtaaaaatgtacttagcagagtaactgacataaaatcataataaatatcaacagttatttgtttaaaccaccatcatcgtgtggctggatcatgtcaacagtttcctgagtggtctcccattagattatgagcccgtgatggtcccaaaaggtgaaaagaagggagattggtccatactttcacccaaaagtggaagagaatgaagttggaaaagctttcggattgatgctatattttgaaaatagtattggttcatttttccttaaaatatatgcatttttcagagaaaggaatggaaaataaaacaaatataaagaagataacatttgtaatcagcacccagagggaaccactaataggtatatatactcctctggatttagagttttgtatctttttttttttcttatttcaaagcatttttctgtatcatatttttcaacaatatgatttaaaaggcacatcccaacatagaaataaatacatgttcattgtagaacactttgaaaaatacagaaaaatattaggaagaaaaataaaactctcactatcctgcaataaccacttttaacgttctgctgaatatccaagctttttttttttttttttcttttgagatgagtctggctttgttactcaggctggagtgcagtggcgagatctgggctcattgcaacctctacctcctgggatcaagccattctcctgcctcagccgcctgagtagccgggattataggcgtgtgccaccacccccagctaatttttgttttttcagtagagacagggtttcaccacattggccaggctggtctcaaactcccgacatcaggtgatccacccacctcagcctcctaaagggctgggattgcaggtgtaagccaccacgcctggcctatcctagccttttttttctatacatatatagtcatactgtatactgtattgtttggtgtcctttttttgcttaacactttatgaattttctgtcataaaatattctataacattatgcagctatctgatttaccataactgtttgcattctctcaccttatacctggctttctaatttcccctattcccctattttaataacagaggaaataataatacatgagtatgttatacaaaattttaatgtacttctgatcacttttttaagaatgaagttttaaaatactgaaacactttttgactcacagagttcataggcaaaatgtgagaaaaatcatcactttgctctccatccttccttacaccctgaaattaaccttagggacagctagttcatttaacatcatcaatcttgttctccagttccaggtcctggaatctagctcttagtgtccgaaagaaacttacttttgtgtaagcacacctattatatactaggcactttacctaatttatctggtttaaacttcacatgcccgagagagatactatcattgtcttcatttcacagataagaaggttgatgagacattaactgtctcagtcacattcagggtagggattcaaactcacatccaatgcctcctcaacctcttttacgtgcagcactatcctctagccccactgcccgtatataggcctgggctatatcaccattgtccgcccttgagcctggaaggaaaatgagctgaggggttttgttttttcagaaaggaacaggatatttcatcatctctatgtttacgtttttcagagaatttctgtgcgaggaaacaaatccattgtcagctttttaaaatatatccctttggagtagccacttaacatcctctgaggcccagatgggctagcttgccgggaccaaaggaaatctttgggtctggaaggcgacaagagatcacaggctttctaggtctaccgcgcaccccgatgacgtcacgcggcgacgttctctgacgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtagttgggggcaggaggggaagatgtgtttcggaattgagggtttagggggaccagaggccaggggtgtggctgatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtaagagacaacctcttccctgctccgtaatggaggagcatatcgctagaatcttgaccacctggggaaagaagaggcattccttactcttggaggaaggaaagagtaacctccagaattgacccgatgtaagagagggggaagcaaatgggggcaaatcttaacccagcatctttttttttttttctttttctgggctctgcagtaatggtctggtttgggaaaggctgtagattaagctgaaagtaaagaaactggaacgtcctgttatttccttatcatttgaatccaaatcatttgttcatgctgcttgttttcaagagtagtcttctattggaggggtggggtggggggggacaggcctttattgaactcacgcggatgcttcattaaacttttgacttttattttattttatttttgtatttttagtgacagggtcttactgtgtagcccagtctggtctcgaactcctgggcccaagcgatcctcccgcttcggcctcctaaagttttgtgattacaggcgtgagccagcgcgcccagccaaacttgacttttgagaagaaaaaatgttttgaaaactgccaaagacttatcataaccattgtggtttaaaagaaagtaaatgcattaagcttagaaaggcagaatgactaagaaagaaggtggtctcaatgagaatcaatttaaatgattagttaccttccttgtatacttcaattgcttagcctcagggtacacttacaaagtagtaatagaaagcagcagatgaaggaggtgcagctctataagaaaacgtgttaagacattccagtgatgactaagcgtgctggtaaggtgagaactgtttgcagtatcttagccgttgaaactttcaaggaagcagaaaggatgatgtataatgcaaacatcctcactaaaagctgggtggtaaaatcaatataaatctaatattctgactgtgtatgaagaaactcaaggaagtccagttctttcattctttctttccttaaaagatccatattttgaaatactaactttttaggcacaggtttgaacgaagctgagcaaggaatatattaaatagggcacgttctcctttctcttgtcctttctttccttctagccttaggttttccagagtttaatgttattttggttaagaattagatgtaaaacttttgaactcctttgcttcgttataatattaagaagctactttgtagtctgttatgtttaaatagaaatcacaggtgattttagcttttgtgtctcataatttcttatgagcaaggtaatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcagtttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggctttgcttatttctctggctcttctgaaggaacattttctccccccataggagcagcttgatttttgaggcacttcagcaaatattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccgcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtcttctgatttgtttttatttacactattttcatttttcttggagtttcttttggcttaaggcaagaaccagcttggcaccatgtttctctgccaatatggttagggaatattttgttactattgtttacaatatggttactagagtgatatcccttctctttagagcagcagggactcttaatttagaatctatcttataggcttctaaagatacttgaccctcctctcttccctgaaattttgtgggtgggtgcattattttctagttaagacaagaacacttaatgctcacagtgaacaggatagtaatatattccttgacattgaaattgttaggggagataatgaaatatgtgagctactgataaaggtatgacttaagacttaggttaatttattgtttaatagaatgtagtgaaaatgcctgttaagaatttactcatgcctgtaatcccagcactttgggaggccgaggtggatggataacttgatgtcaggagttccagaccagcctggctaacaaggaaaaaccctgtctctactaaaatacaaaaattagctgggcgtggtagtgggtgcctgtagtcccagctactctgaaggctaaggcaggagaatcacttgaacctgggaggcaaaggttggagtgagcccaaattgaaccactgcactggagcctgggccacagtgagattttgtctcaaaaaaaaaaaaaaaaaaaaaagaatttaatgggctgggcacggtgatcccaacatgtagtcccagctactcgggaggctgaggcaggaggattgcttgagcccagaaggcagatgttgcagtgagtcccagctgggactacaggcatgtgctaccatgcccggctaatttttgtatttttattagagacggagtttcgccacgttccccagactggtctcgatctcctgagctcaagccatccgcacgcctcgtcctcccaaagtgttgggattacaggcgtgagccaccgtgcctggccaaaaaaaatttaatatgtgtatgtataagaggcttttcagagaaattgggtgacaaattctaaggaggttttgttttaaaatcttaaacaagttttaaaggacatagcatagcatagtaaatatcctagacagattgtaatggatttgagctatagtccttctttgaggctcaagtaatcgtttctgtttactggtttttctgtttgtatatatacattcataaataacttcagatttattccaggtcttttatgtgaagaattcctttcttcatttgcccacttcacatttagtttacattatgaatggactaaatgattataacattctttgaatttttgctagaaacacattgtaaaaacattgcataaggcaagcttcagtataatttttaattataacaagtattaaaggagaaatttctatattctgtaatgatatttgtgagtcctagctcacttcttttaacaagatcattctgtgaatttctggtacaatctaaagagctattaggatcaagactataaatagtaattagctggttggaaagatagcaaatgagtctaatttccattaaactgtacaagtagcacgttttagagatcagatttgaaccagaagtttttcattattttatgtttatctggctcttttttcttttctttaattacattgatttgtttggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtctgaacggatgtctcagtcttttgccttgtttttaactataaactggcattatttgggaatactcttgggctaaatctggattgttggaagtaagaaagccacatttttttttaaatccaaaaatatagttagatacaatgaataagatctagtatttgatagcacaaaagggtgactgcggtcaacaataatttactgtacatttaaaaataactaaaagaatgtaattgaattgtttataatacaaagaaaggataaatgcttgaggtgatggatatcccatttacactaatgtaattattatgcattgtctgcctgttatcaaaatatctcatgtacctatacgcacctactaaatacccacaaaactaaaaattaaaaaaaaaattccatgcataagtcatggttgcctctctagatgtttgttgtgaaagaatattgtcctactaattttgaattttttttttctgaaagagattctttttattgaaagtttcatgtcatagatcggcaaaattgttttttcttttgaccttacactgcttcagaatatatgttttggagtgattccagcttgaggcaaggaagttaccagattttcctgaatggaaagtaattgcagatatatttataaaaaggtccagctttagctcttgaaagctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattcttttctcttgctataggtgcacattaaagatccaaagtcatgactgactccaagtatttcacaaccaataaaaaaggtaagtatgagaatacaatcaaatcttttgaaattttcaaaagttgtagtgtaagattgccccaggcagaatgttgctgacctcttccttcagacatacatgtagctgacaatctcactggacatctactacttctatagatgaatgtattcaagcaagttattaaagagtaggttttaaaagagagggctgtgatgcacattattatgacttgaaggttctgtttagtgaaagagactcctctttgctgtttgagatgatccattggagattggttaagtgtgaggaggacaaaagaagcagcatactttttcccttttattaaataatttttacttggaaataaacattttataacaaagaatacaattaaagcaatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgagggactttgcacttattactctcatcatctttgttatcagtaatataatgcttgtttttacctatgagtttgggtctaggaacaaaggattcttcttgggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattccagacatggcgccaactaccattcttctttttctcttgttgcagtgagttgcttaattatgtcagtttgttgtctgtagctttcaatcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaatttaaaaattagccctgtatggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtagaatatatgactttgcctcttttagtacccctctttggtcctgcccaactttttcctccttatttttattacttacacctcacaaaagccattagccacttgtcattcagtctcagctttttctgattttcttttggaaatatgtttatttcttcttctgttagcattttgtgtgctttgacgaacaaaatgtctataattatataaagggatacaattacaattaaatagttataattttaaaactctcctaattcttcaaacctactcttgaaaagtgtcctggtgacctttttttaattcaggcatttgtaaaagtttgagactgcagattgaatcactgctaataaacatcatacttaaaaaaaattgatagattgtgttccctgtacttcctgcaacacccaccagaactgccactgaaacatattctttaaatttatgcttttggaattggaataatttctgttacatcctgctttgattctataacacctgctgctgttcacaattcagactttctgaaaccccgccgtttgtccttcactgttcccggaagtgaatgagaggaactctaagagctggatttggcaggatgggacatggtgaagagtcctatgaagaatgactctttaaagggcccagcttttcttgctatgctacttttgtagctgttgattaaatagaaattttggaacaatttttttgccttattggccatggatattgaaacgaaaaagtgctctacttctgtgtcttactaatttcatcctttccacataatggtttcaggcaaatcacgtagtgtttgtccccactatttctttctttttttttttttggaggaggggaagtcaggttttaatgtcccagtcctcgggcgccgtcatcccgcgcctgccaggcccggcggccatgtcgctcactcgggtggcggccagcctgcctcatcagggccttccgcggaggccgccccgtcgccctcgagcaccagcttcacgtccagctccagctgcccggtgtagaagcccacggcggcgcacacccagagcgggctggtggcgagtacagcgcccgcagctgcgccccctagcgtcagctgcatgggcccccgcagcgctgccaggccccgcaggcgctgccccacaccgcacacaggccgcccagcaggaagaagccatatgctgcttcgtgatccatgtcactctgcatgaaggagataaccccgatgcccgatgccaggaggccattgtggaaccaggagaagaaagctgtctcgtgcgcctttcggagaggagcctggcgcctgcacggtccagctcggacacaggtggcggcgaagccccgttgtgggggccgtggccgggggcgaaggacccctgggcgcccccgctccggggccactgaggcagcagtagcgacctccggaagcggagactgtccccactgtttctatgctggtaaatgagatctggttgaaaggaacgacaggaacagtcttgaaggtggaggaaagtcttttgaggcagtatggtagatgagctggaggatgtagatggaaagttgagatgggagtagtcaacctctttttcatggacttagtgttttttttccgtttcttttaaacaatattagggttgttactttcttttttattttggttccggcttcttgcagataggtgagcctggagaccaggccttaaaatagtggttacagtccctgacagtttacagtgcggagcctaagcagtcattcaagattgtacctttggaaatgactccattgtgtaccattcttggtttcaagattattcttgtttgattgaatagcaagggccttaaagcccactgatttattaaagtactgattaaagtagtgattctcaacattgggtgtgcgttagagtcacttggtggagctcttaaaggtataaatatgagttctctttgacattatgatttatttggcccagagtggagcctgtactttgctatatttagtatttctcaggtaatattagtgtgtggccagggctgagaacctttgcattcaagagtcaggagacacagtgctaagcccaactttgtcactgactctgtgaactttgagcctcatttcttaatctgtaaagcggagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttaggtaagagtaatcacccttgccattgatcacttcagaggtccataccccatcttatggcctttactgcttttcctttaaaagtatcataatcatagaacctctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcaattgctgaattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaaagctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtattccttaacaccatgtgctaaaaaagagcagtttcacttaggaatgtccttcatgagcagtaaaaatttgttttattaaaacttgaacctttttaatattgtgtttgatgaaatagggattacccataaatctcttctgctgcgtagcagtgcaatggtcgacttgagaaaaaacccttgtgcagttgtttgaactgcaaacaccatttttatgtgaaagaatgattgacagacaaactatatttaatcagactttggtatttgggagatattttattcaaaaatgaacaaagtgaacctgtcacttcaagggaaaaaaattgacaatagatacgtttcaggttttaaagtaaaaaattagaattttggaaaatttgtatctcccatcataagcttgacagcttcctaatgcttaaagacttttctgaggagattggtggtgaaattaatgattgtgattatttgctgttttataatgaaatgtgtcagcatagctcagtgaaccaatatttttccaaatgaccagagcatatgtatatcacaaaattatgcatggataaaagatctattcgaaataaagtgtggaggccaggcgtggtggctcacggttgtgatcccagtattttgggaggccgaggcaggcggatcacttgagggcaggagttcgagactaggctagccaacatggtgaaattctgtctctactaaaaaaaaatacaaaaaaattagccgggcatggtggcatgtgcctgtaatcccagctactctagaggctgaggcagtagaattgcttgaactcaggaggcggaggttgcagtgagccaggattgtgccactgcactccagcttaggcaacagagtaagactctgtctcaaaaatcaaaaaacaaaaaaacaaaatagaatgtaaatgaatggattttaatacaatcaagtacaaaaagtttatcgatacggcttcagattctatattgcaactaacttttaagaaactacagtgtgtggactcagaaagaggaaaacaaccatttgtctagttttatttatttatcattattttttttgagacagggtcttactctgtcacccatactggagtgtagtgacgttatcttggctcactgcaacctccgcctcccaggctcaagcggttctcctgcctcagcctcccaagtagctgggattacaggcgtgcaccactaccacccggctaatttttgtatttttagtagagacggggtttcaccatgttggccaggctggtctcgaactcctgacctcaaatgatctacctgccttggcctcacaaaactgctgggattacaggcatgagccactgttcccgggctgtctagttttagtgtaacatcaagaatttctagttataacaaaaaaaaaaagaaaataaggaatatgtagttatatgaaaaagctattaaaatattatttccttttccgagttatatacgtgtatgaagctggattttcttcttatatttcaaaacaacattctacaaaaggttgaatgcaggaacttatgagaatctagctgtttttatttcaagtagatattaaagagagttgcaaaaaaataaaaaagcagtgtcaccatctcattaatttaaaaacagtacattttacctttaaaatgttatgaaatgggtttattcttattttaatggattaactttttaaaaatttctcagttttaattcctgacatggtaaaatatcaataggtatataacccacatgaacaaaaactctttgggatgtcagtaatttttaagagtatgaagggatcccgagaccaaaaaggtgagggctgcttccctaaccagacggggagcgcagatagaaatggcagcgtaggaaatgactctgtatcttctcttgctccaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagtaagtacatcaggctggcatagtaagtactctttgcttagcaggcaaagaggcaaaattgagtttgttaggtaggtacttacataacaagagagaagacaaatttccacaaattttttattgaggatattcaaaataaaataatagttaagtataatgttttgtaccacaggtatactattaagtgggattctttttgggggatgataacattttgcgtaattaggattcatagtatttttcatcatcagatttgttttatttatttattgttttgagatggagtcttgctccatcactcaggctggagtgcagtggcgcaatctcggcccactgcagcctctgcctcccgggttcaagggattctcctgcctcagcctcctgagtagctggtactgtatatgcacctgccatcactcctggctgacgccaagtgatccgcctgccttggccccccgaagtgttgggattacaggcatgagccaccatgcccggccaagattcatatagatgaacacttagttcatctataaaaaccacttttagctcatggattgtacaaaaatccagcattgggctagatttaacccacaggcggtagttgcctatctgtgatctgtctagtcactgaagggctgtttttgccaaagaataaatctggattgaaaacatcagtacaaacgaattggtaaaaattgtcataactcttttttttttttttttgagaccgagttttgctcttgttgcccaggctgcagcgcaatggcgtgatcttggctcactgcaacccccgactcccgggttcaagtgattatcctgcctctgtctcccgagtagctgggattacaggcatgcgccaccacgcccggctaattttgtatttttagtagagatggggtttctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactaaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactgtccagtggaaatacagtgtgaaccacatatgtaattttaaattttctaatagccattttgaaaaaatgaaaaggaacagatgaattaattttagtaatacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcgtgaaactaccgtaggtaccatgcatacaagtgaaacacatagtttgctttccaggacagaagttactggttcactggagatatggtggattctttgacctgagtccagcttcctttctgtgaataatttctacttctgtacccttttgtgtatataggaccattgtatataccctgtgaccagctatttcattcccttttttccccttattttccttgtggaaatacacctacatttgttttttctttcttctatgctagtagcaagatgtttagcagtattaaaaatgtataaggtactttgataaagcattgtggggaagatttattgctaacttcccataaagttacagttatcctatattgtaaagatacagcttacactttagaatctgacaagctcaacccttccaagctaatggtgctcctttaaatttatttcctgtggcttataggagaatggtaaatcatgaaataactagaacttaggaaaggtataaactccttttatatttgattactctcaaattttcatttgtctgaatatgtaatgttaaaaaaataatttcactaaaagggaatcaggacatcttggaggatgactgattctaggtctggaattagaaatgtacaaaatgagcctggatggggcatcttgtcataaaggaaagtatggaaaataccaggtcatatcacaaggattcaggagctcagttcccactggtcaagactggaagaatatgaactttaaaaagcgtaactgaagtgctttgaaactgtagtagatggatatgaagaattattgttccttttgccctgtcgcactcctgaaagcaagatgattcaccagcagctctactggagccacccgcgaaaagtcagccagggttcttgctattgtgtctgctgaaactgggcacagtctgatctggaaattgagcctcgttacatgccaccagtgtttccatcatacgtgaaggatatagatttcattaagttggactaagtgatcttccacgaatggattatctaaggcacccacccaatgagagaaaccatgttacctttttgtacataaaataaatattttaaaataattattgttattttttatttttatttttgagatggggtctctctctgttcctcaggctggtgtgcagtggcatgttcgtggctcactgcagcctccgcatcccaggctcaagtgatcctcccacctcagcttcctgagtagctgggaccacaggcgcacaccaccatgcctggctaatttttaaaattatttatagagacgaggtctcactatgttgcccaggctggtctcacactcctaggctcaagcagtcctcccaccatggcctcgcaaagtgcttggattacagacgtgagccactgggcctggcttttttgtttttgtttttgtgtgtttttttgaatgtgataaaggtagtggaaaaaaaaaaagacacttgcctgtgcgtggtggctcacatctgtaatcccagaactttgggaggccaaggcaggtggatcacctgaggtcaggagttcgggactagcctggctaacatggtgaaaccccatctctactaaaaatataaaaattagccgggagtggtggcgcacgcctgtaatctcagctacttaggaggctgacacattagaattgcttgaactggggaggcagtggttgcaggaagcaaagatggtgccactgaactccagcctgggcgacagagtgagactctgtctcaaaaagaaaaaaaaggattcttaagatacacattaaaatattatagatgaagctgggcacagtggcttatgcatgtaatcccagcactaggattaacattttttcataataaaaagctttttctaaaactatagagaccttgttgagaacagcactacaatttttttcttgttttttttggatggggacaaggtctcactctgtcatccaggctagagtgcagtgacgtgatcatggctcactgcagtctcgacctcctgcttcagccttctgagtagctaagactacaggtgtgcaccaccacacctagctttttaaaacaaatttttgtagagaggatctcgccatgttgtccaggctggccttgaacacctggtctcaagtgaatccttacaccccagcctcccaaagttctgagattgcatacctgagccaccatgtctggcctacagtttcttttcttttcttttctcttttcttttcttttttttttcctttttttttttagacacaggagtctcgctcttgttgcccaggctggagtgcaatggtgtgatctcagctcaccgcaaactctgcctcccaggttcaaacgattctcctgtctcagcctcctgagtagctgggattacagacatgcaccaccatgcctggctaattttttgtatttttagtagagacggggtttctccatgttggtcaggctagtctcaaactcccgacctcaggtgatccgcctgccttggcctcccagagtgctgggattataggcgtgagccaccgtgcccagccagtttctttagtaattcatttctgtgacagttaccactgtggggacatttgttcttgcatcaaatcactgttagttaaggctattcatgttctgtccaacagcttggcaccaacacctgcttactttccttttctcttttaccctctcttctcagttctctctttccagacgtagtgaactgtatgcagactgacaatctggaactaaagaagcttgtgtatctctacttgatgaactacgccaagagtcagccagacatggccatcatggctgtaaacagctttgtgaaggtaacttttcccaaggcctcaataacagagtttgaattgcaaataagtaacctctgttcacaaggaaggagtgtagggaagtgttggcaatgactaggaatgttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtggcacgatcttggctcactgcaacctctgcctcccaggttcaagtgattctcctgcctcagtctcccaagtagctgggattacaggtgaccgtcaccatgcccagcttatttttgtatttttagtagagacagggtttcaccatgttggtcaggctgatctcgtgctcctaacttcaagtgatccacccacctcagcctcacaaagtgctggggttacggacacaagccaccactcccggcgtgattaattttttttaatggaaaattttaaacatattcaagaaaaaggactagtataataaattcctaaatatccgtcttgcagttttaacagttaccgacacataaccactcttgtttgtaatcctcatacatattttctgacctccaaccccctctcctgctggataattttaaagaaatcctgaacatcatatattaaatagttttgtctttatatttgtcaagataagatcttttatttaaacataaccacaatatcatcatgtctttaaaaatggacaaaatattttcttattattgaatatccagtcaaatctttcctatcatagatttaaagaaaataataatgggatcattcccattaatttttttttttttttggtgacagaatttcactcttgttgcccgggctggagtgcaatggcgcaatctcagctcaccacaacctccgcctcccgggctcaagtgattctcctgcctcatcctcccgagtagctgggattacaggcatgcaccaccacacctggctaattttgtatatttagtagagatggggtttcaccatattggccaggctggtctcgaactcctgacctcaggtgatccgcccaccttggcctctcaaagtgctgggattacaggcgtgagccaccatgtccagcctaatatttttttaatagttgttttttctctgtttggaacttagtgtacatttaaaaaaaacagacagcatttctaaaattagcttctatttaaaatgttttgaaaaataagcaatatgctttcttctttctcatgaactttttgttcttttcctgtgtttagctacattatagagtcagaacgtaacagtttgttctccatgactggtggttcatagagggaatatatcattgggaagaatttagtttacattttttggaagttagagttgtgcatagatttacatgggcttaaagacatttttttagtgtaaggcagtttaaaagagtgttctttctccatattctatttactatatttggaagcacttgctagtaaaagagaatgtatgttagccaagagctcagagggccttctctgctgcttaactccaggtacttatttcaagcccagaccagctcctgtgctcccctttgttttcttggctgcaggccacagaaatctagctctcttttctatttgatgtttaggaactcactgtggagtagggcacggtctttacagctcctcttttttttttttttttttttcctgtgccggaatacaagcccaaaagcttttcctgtttttagggtagatcctaatggctgtgggatggtacgaactccctaaacctctgcctggcactggagtgaatcctgctgagctgtttctcattttgtatttaaaacagttaaatgacttcttcacctaaactcttaaatagggcagctaagatttgtacttaggaaaggaatagcatggaagattggagctcatgtagaatgtatctggaagcttaaattaatgaggtaattcttttgcagcttacataaactggactgtttacttttagccaccatgtatacctacagttgttggtgattgttttctgcaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactttgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaatttctagggcaagattatttttagccaacttggttatgttgtaaatgtttagcagccagaacatagcttaacaccttaaagttttgggaccttttccttattgacattttaaactttgcttatataatgaagaaggtcaagtcccaagtgatatgtttgactccagtaataactaaagctcatttgaattgggtactaattgaatatattggatgggtcattaaatattgttgccaggaagatggaggaaaatagccactttctttaaagtgctacctttttggtctaatgcaatgtttactgaaaggtgcataacactaagagttaatcagtggataacctttgaatattcccttttaaaaattatttatctatctatttatttattttttacagataggatcttgctctgtggccaagctggagtgcagtggtgcagtcatagctcactgtaactttgaactcctgggttcaagcactcctacctcagcctcctgagcatctaggactgcaggcacatgccaccacatcccgctaattttttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccactgcacccagccttattttttatggagatggggtcttgctatgttgcccaggttggtcatgaattcctggcctcaagcaatcctcccaccttggccttcctcagtgaattactgtgcttggcctgaatattttcttagtgaactttaaatggagaattagaatttggctggacatagatgctgtctctcatttgtaaattacctgttcacttctctgctttgacattttgtttggttcattttattttacaggtagccttggcttctgtttattatccttcaagattagtattaaatccacaggatgaagcaagtcataattttttaaggtttttatggtagtaactaccattagaaatctttcaacctaggcataagggtgggcgtcggtgtgggtgtggaagtgcagatgctttaaccatgacttctgacagagcatcaccaccagtactagaagattcaaccctgccttttatttcccctaagtaacaccatatggtaccttttatttattttttattttttatttttttttgagatggagtgtcactctgtcgcccagtctggagtgcagtggcatgatctcggctcactggaacctctaccttctgggttcaagcgattctcctcctgcctcagcctccttagtaactgggattacaggtgcccactaccatgcccggctaatttttgtatttttagtagagacgacgttgcaccatgttggccaggctggtctcaaactcttgactcaggtgatgcacctgccttgacctcccaaagtgctgggattacaggcatgagccatcacacccagccccctttttaaaaattacataaagaaattagttggctaggcatgttggctcatatgcctataatcctagcactttgggaggctgaggcagaaggatcacttgaagccaagagtttgagaccagcctgggcaacaaactgagaccctgtctctacaaaaatttttttaaaaaattcggtggggccgggtgcagtggctcatgcctgtaatcccagcactttgggaggccgaggtgggtggatcacgaagtcaggaaatcaggaccatcctggctaacgcggtgaatccccgtctctactaaaaatacaaaaaattagccgggcgtggtggcaggcgcctatcgtcccagctactcaggaggccgaggcaggagaatggtgtgaacccaggaggcggagcttgcagtgagctgaggtcgtgccactgcattccagcctgggtgacggagcgagactcttgtctcaaaaaaaaaaaaaaaaaaattttgttggacgtggtggtgcatgcctgtaattccaggtacttgggaggccgaggtgggagaatcccttgagcccaggagtttaaggctgtagtgagctatgattgcaccactgcattatagcctgagtgacaaagacagacccttcctcaaaaatatagaaaaataaatattgtctaaagttagtagtatctactttacagaatgtttagctggcaccaacttgtgtttttggcattgcttttgattcactgttattctgagcaactatctataattctctacctgaggacagatgagatgaaaagtgtttgtgctgcaaccgtcaaccaggtgggcagaatatcatgtaccccgtggaaacttattaaatattcagtggtgctaagaatatggaatggctcaaagggaaaatgagttctaacttacaggcgactccagtttgaggcagcatctctatgctaatgtaaattctttaatgcagaacctatacagttagatggtcagggataaggcctaagggatgtttagcagtaaagtcgtgtgtgtgtgtgtgtgcgcgcgcgcacgtgcgcacacacactcaagtagcacatttagagatctttatccagataaaccgagaagaataaaatgattctggaacaagcttagtttgtccgatttattcaaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattatagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgtttgacttagcctaaagaggtgcctggagtgtaaaatttaagaagacactcattctcaggtgcgaactctgtacctcacaagcctgagaacagagtgcctccttagttttgtgcctggagtgcctcacttgccttactcttgtcctggccttgttacacatactcatattaaaatcattttttgagctcttcattcttgttttagtgaagaactgaaaagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcgcacacacacacacacacacacacacacagaactgcttcattttctcaaagtgtttacgtttgaatacataaagactgagttatctgaacactgcttcattatagaaatctcaaaaaagaaaaaaaaaatgaaagatacaaaaaaaaaagaaatatcaatcctcttattccagtgatggatatgagtccttattttactgctcttgaggagtgattttgttccactttttcagaggctactccacatggtggcagcactgcaccagcacatattagattctcttagaaaagaaaagaatgaatgcttccaggggttgtgccttagtagttttcttgtagctcacttcagaagggcatcctagatttgaaagcactagaatatctgcagaaatgactttgaaatcttctaatatgagagataaatgttggtcgagggctgaaaattcttggtgttatattgacctcaagtctggttcctagtgacactgtgccttgctgcaggtaacaaagctttaccatagttttgtttcctgtgttttgcagagaatcacatacatcttactttcctgcagttgttttacaatttatagtttagttgaagctaacttttgatgaaatactagttaagagagaaaagatgaatttagaagtaaaaaaatctcactctattaagtcctagctttatgttcatgttgtttaacttacccaagtctgtttcctttcctggaagatgaaggctactatcttagagagttgtttggattattaattgagcttttgcatgaaaagtgccctgtaaagtgcttggcttatgggagctcataagtggtggctgctactgtaattatgaagtaggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatatcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcatatgctaccatgcccagctaatttattttattttattttttgtagagatggatcttgttttgttgcccaggttggtctcaatctcctagcttaaagcaggcctccagcctcagcctctcaaagtactgagattataggcgtgagccaccatgcctggcctgctttttgtcttcttgggttcagtcctcgtaagtccctttggtttactgcctagcccctttgatcttcatcttccagactgtctatcactctcacagctgcccatgagaatacctgtgcttcattgttctgtcctctctgcaaaattgcaaactgttgaattagtaaaaaaaaaaaaaaaaaaaaaaaaaaatttctcatttgttaagtgttcttctgcataagcagcatgctctcagaatagcctcaattcaggccaaatataatctttaccaaaagttgtagttaaacttccagcttcttttaatttgaacttttgcttgaaaaccattttatgaaaaataacatttttcttctcagaaagcagtatgtattttgactatgtgctagccagcacgtagacacagcatgggattatgatggtggttctcaaccaggagtgattctactctccaggggacatttggcaatgtctagtaacatttttttggttgtcaaacctgatgggaggagtgctactggcatatatcgggtagagtccagggatgttttcaacatccttcagtgtacaggacagtcccccgacaacaaagaattatccagcagtaaatgttaataatgccaaggttgtgaaaccctggattatggaaatagcactgaggcttcagagccagagtggctgctgtttgagtcctggcttggctgcttactagaaatgtggctttgaacaagttatttaaaatgaacttcagttgtcttatatgtaaaactgaggtaataatgccgattttagtgaattattttgaagatgaaagaataatgtatttaaaattttaaactttgcctgatatatggtaaatgcttaataaactgcagctattcttgaggaagtggcctaacattatgcaccttccggttgttataatcttcatttaggcattaggaagtttacttgtgtggtgatttgttgtcaacctaagatgataaaatattgaaaaaatgccatctgtctagatctctttctaagaattttcgtcagaatatatttggtattcatgtaggctatgttaaactgcctattaaaggtaggcccagaatgcatagaaaaacttaatgacttaactttatttagtacgttaattataggattgttgttatccttaaatatatattagtaagtaacaattacaaaattaaaatattatacataaatgaaatttaaaatgtgtaatacttttcatatcaaatgtccatgaaggagttagagctggcagaattttaggcacatatgataatgtcagtatgtggtgagcacttgataagagtaacattgaaggtaatacattcagtctgtatctgagttcctcaaattgtgtttcatattataaaaggagctgctgttaatttttgcaggattgaagtttgggtaagtggaatcattgggggctgctttgatatgaggccaacttcccagctcttgaatttcccaccagttggtctgagtgtatttctgtctctacttatagagaaagcaaacactttttgttttccttttataatgtgctttgtggaaatcattttctgtgtattttcacttttaaaaaatcattacgtcgttttatattattatgaacttaggttttaaaaaatatctcttttttttttttttttttttttttttttggagacggagtctcgctcagtcgcccaggctggagtgcagtggcgcgatctcggctcactgcaagctccgcctcccgggttcatgccattctcatgcctcacacttctgagtagctgggactacaggcgcccaccactacgcctggctaattttttttgtatttttagtagagacggggggtttcaccgtgttagtcaggatggtctcaatctcctgacctcgtgatccgcccgcctcggcctcccaaagtgctgggattacaggcatgagccaccgcgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcacaatctcggctcactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaagaattttaaagattaaattttttaaagctctgagggcaacttacccacaaatgaagctaaatctaagagaactacttactacttttacaaggtaattattcaagggtgtacgtttaaagtagttctcaacagcaacttcctgaaagctggatctgttgtgtgttgttttggtggtttgccagtatatcaaggctcatttgtcactttaagatgacctcaaggctgtaatttggctggggaatactttactctcagaaatggggagatcataagtggtgtgataataagtgttttattttgttcaagttgcagcttgctttaatgaattttaggggccatggtccaaataactgtgatggttataggcatgccttttatttgtttatcgatatttatttgtagtgttttggctttgagagtacttgaattttgttaaatcatatcttaaaccacttaagtaatgaattttattttttgtaaaccttgttactatgtaatcagactttcttttcataatgagatgtgttggctcactaggtagttttacctctcattctaaggaagaagatggggaaaaaatggaatattctagattgtaatgtagcaggcatattaacagttggcattctagacagtgttttggattaaagtataagccctaagttttacttgtttgactggtactgcagtcattgtctccttaaggagataataatgactgaaactctcagaacaaatatgttgtcctatgcctcacatgtcatttgaggtcattctgtaaaggagatagcaatattctaacactgctaatttagaagagaacaaaaatatgtaaaccacctgtgtatttcctcataatagttttggtcagttactctacttctttcactttattcaagtcttcagggataccagccaaaataattgtaaattgagcagaaaaactgaagcataaatctgttcatagtgtgtgaccttgaaggtcattgctggaaatcaaagtcctgtaaatagtaatttacttaacaggaagaagtcactgaactggaaagtggtaagtttctaaggttccaaggccacgaaaatgagtgaaattagagtgcaaggtgaaaatcattttaagggacagggaaatgggtgagagattcctcataagtgagcttatgtgtgtgatattccactcccagtttatatctagatttcctttgagagtccttttttttacagggtcatttttattctaaccatacctactgtaccagctcactccttttttaacaaaatgaggtcaaatttattatcctcaactgctgcatataagacaggtatagatcataaatcatattttatagctaggtagtaaatctttccctccctaagtactgtaggatatgattatctctgaaatgtataaagtagaatacatttttctccttgtatataaatctacatgtcacctttgctggaaataatgtttggattatattatcctcccctactctgaatcttctttcccttcccttggttgaagttcacaagtcttggaagctctataaatgctggagaccaagtattagtactcagacactggaatcagatgcagaccttgagttcagattcaagcaggaatccctttctggctgtgttgaccctaagcaagtcactgaacttctctaagtcagttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaatattagcactttgggaggccaaggcaggaagattgcctgaggccaggagtttgagagaagcctgggcaacatagtgagaccctgtttctatttaaaaaaaaaaacaaaaacaaccagcagattccacaggtccataaggaaatatcatattgaagagaagtctgtaattaaggcagagaaagatttgtctaggattgagtatgattttacacatctacatgtgctgcttttatatatatgtttgtgtttaatatctatctctgtaaagtatacataattgggttagctctttgaggggatgtgaggggtggggaatgtttagtttcagtctccccaagaatagaatttaccataattgggaggcaagatgaataaaggattttttttagttttttattttacttttatctttttggagacagagtctcattctgttgtccaggctagagtgcaatggtgtgatcttggcttaccgcaacctctgcctcgcatgttcaagtgattctcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaaagtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgacgggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcctggctactcaggaggctgaggtggaaggatcacttgagtccaggagtttgagattacagtgagctgtgatcagtgcgactgcattccagcctgggcaacagagtgagaccctgcctctttaaaaaaatacaatttttttcttggaaactctaatttttctgaaatggtagctaaaggccattgttctctttctgtcagtatttcctaagagaaatgccaattttttgacaggagaagtgttacacatagttgtgttaacagttctaaatcaaagtaatagttcaaatgaaagaagcacacctttgtcttagtatacaggtgagtcaaggcagttattgtaagggttggatttgttcttttgtgatattattgtctagagaagactctggaggaagaggaagtaaatcttgagtttcaatctattattttaaaagtttattttaaaaacggaacaatatatattcatagtacagaattccaaagaaacagtataaacattgacaagtgagttgtcatgtactctctagccacccagttgctgtctcaaagttagtctttttctttaagatactttagattcagtgcgactgatttattttaagttttcattgaagagtgagagaaactcggcttacggaccaggaaaactgagagtgctgcctggtgagcctgcctcagtatgttgctaaaaatgtaacagtctgactgtggagattaggagatgaaagtgtagagataggatggaaggaacttcaagaaattttagagaaacattagagttttggtatagaggggtaggatagcatctcctctggacggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagttgcctataataacagaggatttctaattgctcattctgtttagcattcttctggtctttttctccccattgctgtttttaattctcccccttctctcgttttctttgtctatatttcctattactagaccttatatttaatctttttgtttttttaaacatgaaaagggtttcactgacagaagtggtaatttatttcagacaactggtaaccaagactgggcatgtgttggcaacaataaatcaaaacaggcatttggccttctgatatgatattttgattctttagactataataaggtcaactaagtatgttgtgcaagggaaataaaatatcttgcatgtgaagcacatggaagggattattatttctctctttatggcttttctcatgcttgatgatagagttagcaaacaaaaattaagtcagaaaagagcctcatacatgttaccatccagtaggtgggctagataagttttcctgatttgtcttaacaagtataaaatagtatatctgtaaccatatttaccaagtgagtctctgatttttcatcttagcatctttgttctgatcaccaaagtatagcttgagatgattgcatttgtggcatcattatcctttacataataatggacatttttgtaagtatattatttgttaaataaatcacattctctagacatttatcttctagataaaatcatatgctgggataatctgaagattacacagatgatgtgaatactaaaatcaatagctagattgtagtcattatgtttcttcccttgctaacaaaatgataatcatacaaatcttaatttctctagtttttattaagggacttcagtaagaactaacaatggttttacatttttgagaatatttccaatatatataattgctgaagcttgtctcctatcacatctcatttatacttggagaatatttatttatttatttttgagacggagtctcactctgtcgcccaagctggagtgcagtggcgtgatcttggctcactgcaaccttcacctcccgggttcaagcagttctcctgcctcagcctcctgagtagctgggattacaggcacacaccaccatgcccggctaattttttatatttttagtagagacagggtttcaccatgttggccaggctggtctcgaactcctgacctaagtgatccgcccatctcagcctcccaaagtgttgggtttacaggcgtgagccaccacgcccagccaacttatacttggagagtatttatattcagcctcactttgctaatctttcatcagcatctgggaacctcactgcaaaacatggtcttaatttacttgtacaaagccacaatatatagtatttgtatgtatgcatttttttttttttttagtatttttgcaacttttaaatgactttagatgttcttcctttgtagatttcttaaaattaatttgtaattttgataaagtgttgacttttcttcctgcagctaaatggattcccagatctgtgagtcaggatacaagtgtactttctagtataaggtagcaatttttcagccgggcatggtggctcacacctgtaatcccaacactttgggaggctgaggcaggcagatcacctgaggtcaggggttcgagaccagcctggccaacatggcaaaaccccatttctactaaaaatacaaaaattagctgggcatggtggcatgcacctgtagtcccagctacttgggagactgaggtgggaaaatcccttgaacccagtagatgaaggttacagtgagccaagatgtgtgcctactcagaaagaaggatacatttgaaatactgtatttcattgaatctttaatgccactgattataagatgtattattattttctgtattactaagaaagaaaaatgcttcctattgaactgacaggccattgattataaaatgcaacccagtttcaaaggtgttaatgtgaaaaactgtagcttacagttgatgaattatggtaatataaccagccaccttaaatttacataaggctttgtagaaagcacttacacatatgtcatctgatcttatccttaaactaaaactaatctgtgaggtggattaaattatctcgttttcagatgaagaaactgaacttcacagagattacatattctctcagcattgtatactagtgaactagggtctcaggcccacatattctcactctaagacttgtagtatgattaatggtgtcacctcccccaaacccatacatatacagctacacaactataagattatttggcctagatttttctctctgttgcctaatgtacatatttcatattcagactttgtcatttttcatatgctgttcatatgtcttgattttgaaagttttgagtgctgttaacatggttaatgtatgttttcctattaaataacatgtgactctgctaatatatgaattgttttaattctgggttgccttaccactctatataatatcattggtggtttaatatatgttttgaagtgatttatttgtttctatctgactaggtaaaatgttcaggaatggttatgaattgagatccgtgaaatgacccagagaaggctgatgaagtgtttgtctatagctgtgctgttcttggtgaatcaaggtcatacccccttcttttccaggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagaggtcagtctgttttcctggctactttctggtagtcttgcctgatgcagtaagttctggagtctgctattagaataaatctgttgaggaaggtcagtggcttctggggtagatattgctatctccagggtattttctctctggatttaggaatattttaggtggtagaataaactatgcaaaactatttctaagaaatgtatgtttttcatacagttacttctgctaaaatctcttttatcgtcttacgtctcccatgcacagttcttggccatttggccagcaaagattattgagtatctctctttggggtgacagatttttcattctattagatatatagaaagtggcttcatattagttattgagctgacctgtatatataattcagtatgagagagagtatgttaaagtcagcagaatatatcctcctttccagtagatatggaaaccatgtcagtctgaatttgaagattttagaaggcacacctagattgttctgctcagcctgttaccatgtaatgttgcaaattttctttggttattagaaattgactactaaatttcatctacacatacatacattttagtttacaaagttggaattatccctaatttttattgagcattttgtatatgcaggcactgtactaggcaaagtacttctgaagaaatgttggctcttcattaaagttggtatattttaattatggtatttaagaactggtctggctgaagctgatttccaagctactagaatgtaagtgatcttcacttatctgggaaattgtccctctagactgaactaaagctcactctgatagtttctttccatcactgaaagtacaaatatagtctggaaataactttactgagaattttattttcttctgttggccattgacatcacattcattcattcactcacttagcaaatatttattaagtgcatactgtgtgccaggcagtgttccaggctctgaggatacagcagtgaacaaagtcatggccctctgggatcacttattctgaaggatgggggtaggaatatatataatatgtatagataatataatatataatatgtatagatagtgtaatatgtaatatgtgagatggtgataagtactaacaagaaagtaaagtagagaagaaatctaagaaatgctgggcatttgggggtgaggggttgtattttctttttaaaggatggccagggaagacctcactgagaaggtggcattcatataaagacccaaaggaagtcaggaataggaggaagagagaagtacagcctatttatcttctttctttaatacagtaagttagctacttgtgttgcccaagctaccaaaattggattaatttctaaagaaccctcaacagataattaaatatcaaccattttatgaggcatgtaagtgtaggtggcaggggctaggagaggggggagacaggaaaatatagtagtggtgtcctgctatttaaaaaacaaacccttttcagagagtcccttattctcattatccttaagagaggaggttggattgttttccctaccagcctgcctcctgctgtatcttacaatgaaatcttcagccacaactgcgtttgctgtctcttcctatgaaataactctcagaatgcttaatttgacttcctataggttgagtagaaatgggctgagaggcagggagccttaacataatatggggagacaaagaggactataaaacaagaaggtaaatggtgtgagctcaagtgtcttgggtattgctaggttctttccagtttgaacatcccttattactggtttcctgaagtcttcttatgtccctgctctgcctgtagtttgctgagaatgaggcttctgcattgttggatcccaattttacctaagcatggagctttgacttttctaactaattctttaattttttgatacttggccattagactctgacatattaccttatagaatgaattcagcaaataaattataattcatgatattaattttcattctccaccctcagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggttgggaaatagcgaagtgttgattaaagtgtttgtaattttgcattaagcttaataatgtcaatgttaattaggctagtgttaatctctttttaatatatggaaatgaaaatgttatatggcagaaaaacttgcttgcctagcaccaggaggctaacagttgatattacagtgtttctataataaatgccatgcgttgctccacaatccagtttgttttctgaagggtctctttctgatatactgtctagtgcctggttgatatggttcaggctgtagtttagagccagattgttgttctagcagttcttcatggcaacatgtgccctgatgcttaaaaaggataaaaataatctgccaagtggaactgataagaatagaggcgtatagaggaagtttatgcttttttttttttttttttttttttttgcctgagtggagcgagaggagagcagagaggcacagattaggtattaatacagtctcagaagggtatatcagtatatgccttcaccttcctttcttctgtttctgtgtaccctaggcctgaaatcttgaagcaggaaatcaaagtcttctttgtgaagtacaatgatcccatctatgttaaactagagaagttggacatcatgattcgtttggcatctcaagccaacattgctcaggtcagactttatgcagactcaagttgatgatgatttagctcttaaggtctggcctttaaagaagctaggctgtgagattgctatttgagaatccttaatgattaaccacttcctgggtttaacaggttctggcagaactgaaagaatatgctacagaggtggatgttgactttgttcgaaaagctgtgcgggccattggacggtgtgccatcaaggtggaggcaagtgtctgatggtagttaggatcatgtattggggattctgagagttctcttcacttttttctttaaaataatttttaagtttatcaaaataataaagcacacagtttcaatgttaaagaatttttaatggaaagcagctgtctctggttcctcccttccctacctagactttcttctcagagggaatatttttaactctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttggtatccacaggggcccaggaaccaatctcccatggatttggagacatgactgggctgccatatctctaaataatattcttggctgggtgcagtggctcacacctgtaatcccagcactttgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgagtctgggaggctgagactgtagtaagctgttattgtgccactgcactccaacctgaaaccttttcactctgggtgacagagcaagacgctgtctcaaaaaaagaacaacaataatattcttatgctattatttattaatttacctatcatagactttttctgttaactatctgctataagaagtttacttcatacacccaccattcccacttctgtctcctgttttccagtgtagttacataatgaaggtttttgttcctatatccattatcatggtagattgaaataatatgcctttgtttcttattctatcaactgttggcttgcaaaatttatgcatattacgactgtgtaaatatttagggccaatgtaatgcaaatgattacattttctttcttatagcatcttttttttttctggaggttttttgttttgttttgatttttgagacagagtctctgttgcccaggctggagtgcagtggtatgatctcggctcactgcaacctctgcctcccgggctcaagcgactcttatgcctcagcctcctgagtagctgggattacaggcatacgctaccacacctagctaatttttgtatttttagtagagacgaggttcgccatgttggctgggctggtcttgaactcctagcctcaagtgatccgcctgcctcagcctcccaaagtgttgagattataggtgtgagttaccacacctggccctggagtttctttaattgcctctttttttcttgcatgtgtgtctttatcatgcccctatattattcctgttccttaagcataatatcaaatctgtaaactttcttttgtcttagacccttctcttttgcagtcctctgtcttcttgttttttctactctgactgattgcttttctggcttctgcacatcattccatacagcctccctatttcttgttattggtatatttttccttgcattgctctttttgtggttgcaatagcttcttgaatctctgaggatatgaatgattcgtttttttgtttctgcactttgaatttaattatcggatattttttggtgatgattgcatatctatacatataattttttaattgagatgtataccatgcatacagtaaagtgcagctcgtttctgtttaagaaagaggtaacagaaaagttgattaggacttctgtatacataggcaaggctgtcgactatcaggtttctgctttagggaagggggtttatctttacatggaagacctcttgaagagcctatctggtcttagagggcagattggtttctagcttggctgcagccttccggtaagtattatgggctgtaatttatattgccctgcttcatcagtcagcagtcctccatttgtttgtcctcattcagaaatttgttgaaattaacagtggcttctgttcactgtttttatgggttcagagccccatgtttgttcttgctacttgattatatgcagttctgcctagagtcagaggattggaccatatgatttctcaggaatacgaaaacaatttgtacagtatgaccagtactttaccggaacaaaaggaggcagatgtgtgtcagagaatcttctatgaaatacctgttcctaattggccttccttgttttttttcagtttagtgctgcttcatgtagtttctgttgataaataatttaatagaaaggctgttaacagcaagaagttagctagtcctgggttctattcctggttctgctagctcacttgattcagatatttaatgtttctcttcattggagaaatgttaaagtctttttgttggatcttgatatgttaacattgtttttattaccactgtcaccacacgtcacaacttgtttttcttttctttttacgttaacatatcttactagccgtctacttagtattaatgtagataattttcagagagattttggtagcataagagtaaggtggttttgttctcttcactagtgtacatagccatcttttccacaagactgccattgtcttatgacctacctctctgacaaagctgtaaacagtaatacaaaaattatatcttattctgaagttcagagactttctagccctggaattactagaaagtgttctcaaagcatctagattcctcaaggctgttagtcatctattgtgactaatggaaaggttctccataatcttctggaaaagacttctgatggctttcacttcttcctttgactaagcgtgctttgatgggagtatgacaggatgtgaggaatgaactttcccaggaaacttaaggtcacccttcaggaatcctgtcttatctagtgctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaaacaaactcctggtccttttcagttttaaaaaggagagaggttgaggcactaggttaagaccaggagttcttcacttcctggtcttctggttattttctgtttactatttctgatttttatatattagaataaaatattggtttgtgtgtcatttcttaaagacaaaaaacatatttttcctattaggaaaaccatatttgtttactatatataattatagaacaagttaaacaaaaaatggggtaccccgcttcccccatcttctgtttcactctctcagatatgcagtggacataatctggtagacatcattttatatcattgtttatatagtgttctatacaaagatgtatttttttataaaaatgaaatcattccacaaatgctatttatttactttgttttatcctctacttttttttttcttactagtaatatcatggacattgatccacattataaagaaaaatttatgtcatctttagtttctggtttatagacataacgtgattacttgataacttactgaatttgtaactttatcccttattataggaccttaaagttgtttctactctttttccaaatggtggtataaggagtatccttgcaactaaatctttgaactctagttgaagtgaacattttttcataacagttatgcttattagccatttgggaattgctcactcatgtcctctgcacctttttccaatatgttatcttttccacattgttgttttaaagtcttttgtaattgagatgttaacccttcttttagttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactatttttttttttttttacttctatggcaatgattttgttttatttgttttttggggggtggtggggaaatggagtcttgacttgtcgcccaggctggagtgcaaatggcgcaatctcagctcactgcaacctctgcctcctgggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtgtaagccactgcacccagcccttgttttatagtttaagggtaattttaatcaaccgggaaataattttagtgaaagatatgagtagagtggatcaaacaccagaacaaattgttctttccttactgttatgaaatgttgtctttatcatatactgaattttgtatgtatttctgtttctggactttttgtatatacaatgatgggatgtttacttctgttcctctgccatactgctttaatggtagttttttttttttaatcaaaagcagtatggttgagatgataattttctttgaaaattaatatccctgacataaatgtttttcaaatgtttatacatcatgagtaacatccttttatttgtattcattttaatgataatactacggatttactaaatatgagctttatatcaagcactgtgctaagcacttacttgtattattaatttatggtaattcaatgcttacagtggcccatattctacatactacataatttattaatataacaattataatattaataaatatagcatatttaaatttttccaactgttttgctgttgcaataacagcaaaggaattaatagctgaaaatgaataaaatagaggacataaatagaatcagaagaaggacagaactacataaaagactgcagaatcggccgggcgcggtggctcatgcctctaatcccagcgctttgggaggccgagttgggcggatcatgaggtcaggagatcgagacatcctggtcaacatggtgaaaccctgtctgtactaaaaatacaaaaattagctgggcttggtggcccatacttgtaatcccagctactcaggaggctgaggcaggagaatcacttgaaccagggagtgggaggttgcaatgagcatagattgcgccactgcactcagcctggtcacagagcgagactgtgtctcaaaaaaaaaaaaaaacagactgcagaatcatttcatggtacaacagaaccatcctatatatgacctcatataaatgatctcaaggtacagttttgtttttattaaattgcttatagtggtttagattgttatagtacttctaaagatcttattacagaaattttcaggtgtacaataaagtaaaactgaataatgagatcttgtgtagtcatcatccatcttgagcaaatactgatatgttaactgtttccgttttatcttctccctcttcctcttccttcgggtgggtgggatgcgaatacaaatcccatatatcatcttactcaagtagtccagtgtgtatatctaagagataagatactttaaaaaatatattgtcacattaccatgcccagcaactaacaataattcttaattttattgaatattcagtacatgttcaattgtccctaattatgtaaaaatgtctttttacagtttgtgcaaatgaaaatctaaatatggtctgggccaggcgctgtggctcacacctgtaatactagcactttgggaggccgaggcgggcggatcacttgaggccaggagttcgagaccagcctggccaacacggtgaaaccccgtctctactaaaaataaaaaaattagccgggcatggtggcgcacgcctgtaatcccagctactcgggaggctgaggcaggagaaatgcttgaacccaggagacaaaggttgcagtgagccaagatcatgccactgcattccagcctgggcaacagagtaagactctgtctcaggtctgcacattgcatttgaataatgtgtctcttaagtctttttacttacttattttggtgccaggtattgaagaaactaggtcattaggcttatagaatttcccacagtctggatttggctgttgtatcttagtgatgcagttttatctattcctccatcctctttagataattaaatctagaggcttggtaattttcttgttcagaatttttagcaagaatacctattgggtgattctctgtacttcctgttgcatcttatcaggaggcacataatggagtgacccattatagtacattgtaatatatgataggctggtccttgacttttaggatctctgttctggtatctctctcttttaaaaatgatcacttatagtttctgtacatttgttttttcacctgtattctctcatattctcttcattaataaaagattaacagataaaactccattttatagattaattataggctatggaaaattgttgtttatctaatgccatagacttttaagtttcatagccccaatattggtaaattgtcgagtactacagttctttggagtgttttggatcatgtgtaactttgaaaatgtaatggaagttgtagacccactcactggaaaatatgcttgaaagctcctacaaaatttggcgatttcatttcagtaggtttaaagacaccctctgctatctccactcatccatgaacttcagttaaagacctcctactttggcttattctttaattcttattctttcctcctacgatggcttattcttcttacttctatctcctggctatccaagatgggtgtgtgtgtttctctgtttctggactttttgtatatacagtgattggatgtcactctacttctctgccatactgctgtaatggtaggtttttttggtgggggtgggggcatagtctcgctctgtcggccaggctgtagtgcagtggcacgatctcggctcactgcaacctgtgtgtctcccgggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtgtgatctcggctaactacaacctctgcctcctggattcaagcaattctctgcgtcagcctccggagtagctgggattacaggtgcctgccaccacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattacaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatcaaaagcagtacggttgagatgagaattttctttgaaaattaatatccctgacataaatgtttttcagatgtttatacatcatgaggaacatccttttgtttgtattcaaaggattcatttgaactgattcacctatcagttcaaataataaataaaactgtatcatatagcttggtatctagcctgtagtacagcttggtcaaattaagtgcctgatcatttagtttggtttagttgatgcacctgcatgtttcaaaatttttatgttgaggtggtgttatcgcatagatcatctgacttctcattttttgtatttttcttcccagcaatctgcagagcgctgtgtaagcacattgcttgatctaatccagaccaaagtgaattatgtggtccaagaagcaattgttgtcatcagggacatcttccgcaaataccccaacaagtatgtccaaatacctttacccctctttctcaaattacttaggaaatgtttaaggcactttgaaattgcctaggtaagaattactcttttgaatgttcctggtcataataggatactttatcaaaaatcggaaacataaaatggttagcacagggattaaaacctgagttttcactctgctttctttctttaggaagaattgaagctctgcctgaatatgcattgtctattggcatattttaaagttaaccagattctttgatggcaaagttactgttaaataggacatctatatattctaggttgttcaggcataatctcagtttatacctgttatccagacataattaatgattgtgcaccttttcttctcagaaatgtataagtttggatgatatatcgtatagcaccctaccataaaagccaggaagggaacagctgtgctatttactttgcatgttacctactacattgtggagaattacagaacatgtaacattatcagtctcatgccttttctgaagtattgtagttattctcatacagatatataaaaaaaaatctgcatttttacttcacaagtttttcagattgagggcctcttagtatatgaagcaaaaatactttttagatttgatttttgaaaacaagtaattaaggaatctgaaaatgaaataaaagcaggttttataagcatcttaaatctcattttgccttacactcatagagcttctgattgtcttttttgagacggagtctcactctgttgcccaggtgagtgcagtggtgcgatcgcagctcactgcaacctccgcctcccgggttcaagtgattctcctgcctcagcttcccaagtagctatgattacaggtgcatgccaccatgtctggctaatttttgtatttttagtagagacggggtttcactagccaggccagtctcgaactcctgacctcaggtgatccatccacctcagcctcccaaagtgctgggattacaggcatgagccacgatgcccggcccacttctgatcgtctttaaagatagtgttaaatgaagcagcttgtagtaagttagcttagtggtgggctcaagaattagtagatatattttggcaaggtagtggtttattaagcattgtgtatatttttaaaattttagaaatagttattttggaaagagaaccacatacttttactactctcccaataaagaagagggtcggtttctaaattttttttttttttttgagacagtctcactctgttgcccaggctggagtgcagtagcgtgatctcagctcactgcaacctctgcctcccgggttcaaacattctcctgcctcaatctcccgagtagctgggattacaggtggctgccaccacacccggctaatttttgtatttttagtagagacagggtttcactgtattggccaggctggtctcgaacttctgacctcaagtgatcccccccacctcgccctcccaaagtgctaggattatgggcatgagccactgtgcccagcctaaactttttttaattaacttttttgtttgtttgttttcagacaggatctcactgtgttgcccaggctggacacatactcctgggcttaagtgatcctcttgcctcagcctctccagtagctaggactacaggcctgtgccactgtgcccgacatttaaacttattaagggtgaagatgtgtatctgaatgtgattggtagagaaatgtatccatttctggtttatggttaataaagagttaggacggtttatgtttaagaaagcaatcaagagcctggtttaatcagtaaaagtaggcagatacttagttaagtgtgctatttagttgtccacatctaatttattatacagggtcattctaatcgttaaaactacattagccaaggagatggattcaacatggtaagcctgagagagctgtagatatgtaaaaataaatattttaattacttctttctttggagaaataagtcagtgcaggtacctttagaagaactaacataaagaaagatctctttggggccaggcgcggtggctcacgcctgtaatcccagcactttgggaggccgaggtgggcggatcatgaggtcaggagatggagaccatcctggctaacatggagaaaccctgtctctactaaaaatataaaaaaattagccaggcgtggtggcgggcacctgtagtcccagctactcgggaggctgaggcaggagaatggcatgaacccgggaggcggagcttgcagtgagccgggatcgtgccactgcactccagcctgggcgacagagcaacactccgtcttgaaaaaaaaaaaaaaaaagaaagctctcttttataaaaagcagagataagtggattaagggacagatttaccatttcttgtctggacactgttgttgtctaacttcatttgcctaaaaataaagtggaatttctgttcctctctaccatgaaggcaaaatggaacaataggaaaattttctaatgtacttatatgaaagattgttacaaatacaaggtagtggtattatcttacaccacaggttaatttttccttgtaaaaatggcagtgtggctcgcacctgtaatttcatcactttgggagaccaaggtgagaggatcacttgaggccacaagtttgagaccagccggtcaacatagcaagacccccatctctacaaaaaaatttttaaaatttagctgagtgtggtggcactcaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcccgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttatttatttattttttttttttgagacagtttcactcttgttgccaaggctggagtgtagtggcaggattgtggctcactgcaacctctgcctcctaggttcaggcgattctcccacctcagcctctcgagtagctgggattacaggcattcaccatcactcccaactaattttttgtatttttagtagagacagggtttcaccatgttggccaggctggtctcgaactcctgaccttaggcgatccacttacctcggcttcccaaagtgctgggatcacaggtgtgagccaccttgcctggccagttttactgatttctaatgttaaaaacctacataactcagaccagtagttctcaaacttcagtgagcattattaacacctggggggcatttttaaagcacatgttgctgggcttcaccctgagagtatctgactcagtaggtctgagatgtgcctaagtatttgcatgtcttacaaggttcagggtgatgctgctgctggcaatccggaaccacacattgacaaccactggcttagagcagtagttaccactacttttttattttctgtcacctaagaatgactacacatttctgttagtaatggctgtggctcattacagcagggattttcgctagaggctgtggtgaggtttgaaaagattatctttggatgaaaattctgagactgcttctcactttcccctaccaaaattagagccacagaaccaggaagccaataaattattaagcccttttttcttggcatttgtactcaaagcaaatagaaaataatgtatgtaatctactatagcaattttaatagacctaattcaaggagtatgtacaagtcaatagctttgtggtttagcagccaactcctaataggctgtaatctgacataattctactgtcttggctcttgccccagtacgacagatgattccataattccccccaaattgtagcttttggtagaagtaaataatgaaagacttgctcaggagccaattttatcaccatcagtatgttaacatatactttaagaaatacaagccaggctcggttactcatgcctgtaatcccagcactttggaaggctgatgcgggagaatcgcttcaagccagggctatgagaccagccctggcaacattgcaagactacatctctacaaacaatacaaaaattttaaaaattagttgtagtggcttgcacctgtagtcccagctacttgggaagctgaggcaggaggattgcttgagtccaggagtttgaggctacaatgagctatggatgtgcagcctgggcaatagagggagaccttgtctcaaaataataatagtaataataataataataaacacaggtaactatctgtcttagaaacaagcaatattttgtgccaaaaatgcatttcgaggttaaaagggtagagttttcggttgaatacctttgtatttcccacgaatacttttgactgctgttgttgatattgattgagtttcagccttttgtctcttaaccaaaatcagaaaggctccatagtaattcatagttggggaaacaccactttggagatgatggcagggaataatgccagtgccattctttcactctatcacaaattatgtctgtttaggtgcagctcactctgcttactgccatagtgaagctgtttctcaagaaaccatcagaaacacaggagctagtccagcaggtcttgagtttggcaacacaggtaagaaatctggaaaaagcaagatgttgatttgtcttgtttcaaattgtaggaaattatgaaactcttcctaggggattcatttggggaagctttatttgaaggaagtatggcctttagatcctgttaaaatattaaaacaatgcctttttacgtgttcaactgaattgtagctaattctgtggcttttaaatgagttgactgattccagttttcataattcatgaaaattgaacctagactcttagtttagtgaaggacatacttagatgaaaatgacgtgatctgatagtacctgcttcactgtgacttcatttcagctttcaaatgaaagtggagataatagatgcctcagtaaagtttcatgcattgttctaccttccagagtagttgcctttctcacagaaattaagtgtttatgctgcttccttgtattatttgatatatttggatctccttggaattatttgtttttttaggtcagaagaaaagaagtttagatggattcagatctcaggaaagtggcagctggctttaaatatcaggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaatggaatatgattcagatatccagtttaccatttttctgtctttgtcatccctttatactggtgtgtaatcaaaatttaaaaccctttcacagtactttgcctagttctgagccataatttttcctgttattacaacttaaaaaaatgtatttgtatgagctttttgaagtattttaaaaactttcttaagcatcttcctctgcctgaagcaaagcaattataaacatcagtggttaatattatctgtattgaattgagcattctaatttcctggatcccatttgcatctctaagatgaattcaaaacaatttctttattcctcccacaccccccacagccttttttttttttttgtactctgtttcatgttttaattttaaactcctaagtcaggagtgtccagtcttttggcttccctgggccacattgggaggagaattgagaattgtcttgggccacacataaaatacactcacaatagctgatgagctaaaaaaaaaaaatcacaaaagaatctcataatgttttaagaaggtttacgaatttgtattgggtcacatgtggcctcaggttggacaagcttgctgtaagtggtcacatagaatgacattattagagcagctcacattctgtcaaaacaatttctaaagagaattttggcctttcttcctctctgcttactgtaaatattcaagcaagtatgtttagtagtttcctctgttttcacaagttctcaaccttatcatcattgtctgttaaagcctatgtgattgtatttaacaggcaccataggagagctgtattacgaattctggccagacttcaaactcagtctcattacctcttaagtatttatcaaaatttgactgagataaagtatttaggaaggattgcttaaaggatacaaggtagtgctgttcttacagatagtctgaaattcacctctgaatcaagcattattaatagacatctggatacctggactgcattgtttttgacccctaataaaattgcttttactaaattacgctgatactaaaatactatcagtctgtagtaataacagtcgtcatgggaaactaccctatttggatctgttgttagcttgttatcagagtcattacttacttcattatgttttcttctttatgaagccccatcaaatttctaacaagttttggatttttctgtgtatcagtgtagcatgcctgatcagctttcttttccatattggttgtttgaaaccttagaatcacatttaacaatctcccatggaaactatgtaggccactgtggcatgcagtttcctgactctgggtttaattaacgctctttagccttagatgcatttttcataagcttcctagaacaggacaggctagaaactcacttaatcctagtaagggttagtaaacgatttctattttatagatgaggaaactcagagaggcctaattattatggggcagaactaggactcagactcagatagtctggctctaggtcttgcccacggtcttgtccactgtgctatgcttcctctctagtctgaaggttaagaatgacttggagaatacctattccctgcctgaagcaatattgagcataagcccatatgtatatgtgtgtttgctagttttaaggtctttgtggatgattatttcatactataaataataagcaacttctcgaggcttgccttttttcaagactgagtctagctctgtcacccaggctggagtgcagtggcgtgatctcggctcactgcaacctccacctcccgggttcaaacaattctcctacctcagcttcctgagtagctgggattacaggtgcatgccaccacgcccagctaattttttttttttttttttccagtagagatgagggttcaccatgttggccaggctggtcttgaactcctgatctaatgtgatcctcctgccttggtctcccaaagcactgggattataagtgtgagccacagagcctggctgaggcttgctttttctgtccaattaattaatgaagtctgagaagttatcataaaacagtaagtatgctgctgggtgctgtggctcacacctgcaattccagcactttgggaggccaaggcgggcggatcacttgaactcaggaattcgaccagcctgtgcaacatggcaaaatcccatctctacaaaaaatacaaaaattagcggagcatagtggcacacgcctgtaatcccagctacttgggaggttgaggtgggaggatcgcttgagcccaggaggcagaggttgcagtgagctgagatcatgccactgcactccaggctgggtaatacagcaagactctgtctcggaaaaaaaaaaagaaagaaaaaaagaataagtatgcctatgtaagtctttttacctggaagttttctgttttttccccaagtttgtgaaataagaacctaaatatttatggctagtgagtaccaatttaagtttaggatgcaatgtggtcggctgaattgtgttaacttaaattggtatatgtgctgccgaagcgagcacatgttaacttaaattgggtagtgaggttctgatgatgctacttccactgattctggacatgactgagcaaatttctttcatactgcttttcttctgtctctatagtagagttaattaatactgttctttacctgtgctgagaattaagtgaagtatatgtgaaatcttagtgcttttaagtaaaatgggagtataattaaaaatattattagttagggggaaaaacccaacccttgaatctgaggcttcatttcaaaaatttatctttttctcttacctgttacacagaaattcaatacaatattcagttcaactcagtaaagaatacaaacaaaggccgggcatggtggcttatgcctgtaatcccagcactttgggaagccgaggcaggtagatcatctgaggtcaggagttcgagaccagcctgaccaaaatggagaaaccccatctctactaaaaatataaaattagccgagcgtggtggcatgcgcctgtaatcccaactactcgggaggctgaggcaggagaatcacttgaacccgggaggcagaggttgcagtgagccaagatcgtgccattacactccagcctgggcaagaagacctagactctgtctcaaaaaacaaaacaaaacaaaacaaaaaaatgtctagacgttagtaattattctttgtgatacatggaatagaagtcttcatgtttttctgtctatgaactaggggccaccatcatcagaatcatttgggctgcttgttaaaaatactaattactaggccctacttctgatgtaatgaatcagaatctctgaagtatggcccctgggttctgcactttcagtggcattcctggtatgttaaaatgttgatgcacattatagtttaagaattactgttttagtgctggcctggtaagtattgttttgggacctcttcccctgaggaaggcctatgggtctagcagtacagtagatccaaagccaaattatctgagtcaccaaacatttaatggcaacttaagattacaaaaaggtcctgtatttttatttatctcggtcttgacagtctgaattactgtggcctccatgtaaaatgtgaggcagttggtgaggactggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggtggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgagatttttgaattttgtgaatccctataggaatttttctttttggtcatttggttaaattgtttacattacatatgggagaaataatttgaagaaaaagcattttattttgatgagtatattattaaactatgtattataaagttgaatacctttaagatattactagtccataaagacaaactgaattttctaagttaataagataaatgcagtgtttaattatgtaataaaaaccatactttacaaattctaaagtacatgtgctttaaggactgcatatataggttaaaatttaacgtttaagttacgtataaaaaaatgtgggagagaggagttgcttccctgacctgatattttgagaaacttgtattctgctcttttaaaaatatcaacttgtttttgttttataatgttcaagctttgttttcaaatgaagatctaaatgaggaggtttcaggctgctatttataaacacttaggagcaaattagtccctcagtgccccccctccccacacacacacaaacaaaatcaactaaattagatataattatcactgtttcttttttttaacccgggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatatagtcaaaaacatcagggtaactactgctattgaactggatgataagggccttaagtggctaaatcgtgaatcaattcatctgctcgcttagaaactaaaatggaagccctcagattgtcctgttttaaagaaaatgttttttgtttggttatgagttttttgggttttgggggtttgttttttttttttttcttttgagacagagtctcactctgtcatccaggctggactgcagtgacttgatctcagctcaatgcaacctccacctcctgggttcaaatgattcttctgcctcagcctcctgagtagctgggactacaggcatgagccactgtacccggtctggttatgagtttgaaatatagaaattgaaacagggacttattgttgcctttaataagttgctgttggaacaactcgtgcataaataaatgccatcatatagacatacttttgaggtaggtaccaggatatttattgccactttataatgatgacaaaaacaataaagaaaacaataggccagacacggtggcttatgcctgtaatcctagcactttgagaggctgaggtgggcggatgacttaaagtcaggagttcaagaccagcctggccaacatagaaaaaccctgtctctactaaaaatacaaaaattagctgggtgtggtggtgcgtaccaataatcccagctacttgggagacagaggcaggagaatcacttgaacccgagaggcagaggttgcagtgagccgagatacgccactgtactccagcctgggtgacagaacaagactctgtctcaaaatacatgcatacatacatacatacatacatacatacatacatacaaataaaacaataataaaggtagaaagggaaaaatgggcaacagtgaaaatgtccctcaatagtggactaataattaatggtgcagtgggcattacagtggaaaagtgcagtcgtatatatcaacatggagagcaacttcagaacagtatatataatatgaaactggttttatatgaaataagtgtgtgtgtgtgtgtgtgtgtgtgtgtgtgtgtgtgtgacccatctggacagatatataccacattactaatcatggctatttgggggattgggagttgagatggagaagggttggataattgggggagattttttttttatgtcacacacttaaaaattgtgatgtggtatgtttggtaataatttctttttagccatgaacatgtatacaattatttaaaaaccaccatagcacaaaacaagaccaccaaattcaagtgttactccttttggaagcagttatgtcctctctttagcagtttttgattatttagataatagtacctttcatactctattgaaatagttaatattacgtgagctccttaaagtcaggcagtgtattgttacctctttatttccagggcttagccagtgtctcaataggagatacttaataaatatttgaatgaaggaagaaggtatgggtacaatatatggaagatataatatatgttattaataagcctgctaatatttaaagcagttaaaaaaaattttttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaagccaccgcgcccggccctagtttaaaaaatttttatgtcctaaggccgtctcaaccagttaacttttgccagattaaacattgtttttctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcctgggctcaagtgatcctcctccctcagtttcctgagtagatgggactacaggtacatgcggctctacaccccgccctgataatttttgtacttttattattattattattttttgagacagagttttactctgttgcccaggctggagtgcagtagcgtgatctcggctcactgcgacctctgcctcctgggttcaagctattctcctgcctcagcctcctgagtagctgggattacaggcacacgccaccaagcccagctaatttttgtatttttagtagaggtggggtttcgctatgttggccaggctggtctcaaactcctgatctcaagcgatccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgccttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctcttctttatgcttttatagtctggaaaagaactgctgtacatttttgcttctttatgcttttatagtctggaaaagaactgctgtacatttttggacacctactactatacaaccccagggagctccatctgaataccagtgaccacacataaaatcggtgaaagactcctctgtgttccaatctaggagtacattatggctttagaaaattgtggtgaagaccttctaaattgataaagtctgaaagttgcttaagtctgcagtaagaagagactagaaataaccccatagttgaaaacttggaaaaaagcctgtgtatacatttagccatcttgatccattactgtagcttttgttgagccttctggatagttagcaggtataacttatgctgtaaagctgttaatgaaataatatttcagtattgttttatttaaaaaaaaaagcctgacttctatgtggacttagtttttcagttacctgtacttttttatattggccatatcagcaaggaaattgttatgaaaaggctcttgggtaacatggagctcttgctttgtagctatcttaaaattctaattaggcagaagaaacactctaataaactcttacaatgggtatctcagaatcttttcagaatctgattccttcatcaatcatagtagaccttgattgaagtaggatttccttccagagtagttagaataattgggcttctattaatgagtgtcttgtaccattgtctaatatatattattgtttaagtggtttttgtgaatggccaaagtataggatttattgctttacaaattggcgtggtcagcattttgggttctatgtaaatagactgtggatacagataaaggaaaaaaaaaacagcaatacccaaggagattattaatctttcataattgagttgaatctttgggtttacagcaggtgctataattttaatccagaggagatgtgagcttcataaggattagtctttatagtaagttagggtgtttctccttgtaggcaaacatgtttaacattctatagatgagactatttaacttctaagaatttctcccagtctgtgcttcaagtttcgatgtagatacggattttctgttgtaacttccctctgtaaccgtgtttgtatctagcctcctgctaacttttaaccctcacatggaagtggggaaatgaatcaacaaacaaaaacaacgctttcttaaacacagggagagaaccaacatttaaactgtctaaaaagaaagtgtcttacataaggcttttatctgattaatagcctttaagttcttatcttcacaatttcttttgtggttcctttttggataacctcctttttgtcatttgtgcatgttttgtgttttttaaaaaaatgcaagtacagggaaaatctgttttgatataaatgggaatgatacgttgctgcaaatgacatgtctgtaatagtattgacattacctagctctcttctgcaatgtgaggttaataagtgatacacctctcataggaaacaaagcaacactttaaaccttattctgcatcttctagaggtttaaaaatactcacttcactaggtcttttaaaatcatctgggaaagagagaagtgatttttacttggatattgcttactatgcttatacttgtcagctgctctatgggggtgaggtagtaaatagttgtctaattcagaaaaatctcacctttaaaaaatattgctttaatgacagttatgcagttatttcccttaaaattggaaatgtctttatattaattttcttatattttccattgagaaagatgtataataatgatgtatcatattcttgtagaatctataggatcatttatatcttttcattgaactcactttatcttctcatattattcattcctttccattagagtgaagaaaaatatgtgcatgatacctattctaccttctttttagacatactgatagaaccatgtgttctgtcacattttctaaatggtatgtcagaagatgacagaatttcatgtgtagagaatactctgtgaaagattttatttatttcttgtcaggtgtatgaaatcatttcccctttttacttctttcttaaagccttttcatcatggcttcctggacactttccttgtaaattagctttcctagattgtatttctgtctttaatctttgcagttccatgtttcttctcttctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaaccttatgcttcagtgatattgttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctcactgcaacctctgcctcctaggttcaagaggttctcctgctacagtctcctgagtagctgggactacagatgtgtgccaccacacccagctaatttttttgtacttttagtagaggtagggtttcaccatgttatccaggctggtctcgaactcttgacctcaggtaatccagctgccttggcctcccaaagtgccaggatcgcagacgtgagccactgcgcccggctggaatatgaacaggttctgaattatcgaccccagtgctctaccctgagactctgggcatgagccaccgtgcccagcccagtcccttgttgctgtcaggcttctctacttgtttttcttacttatcttaacagaattgaaacctgcacatataatttttcctgtcgtccttctagagtcccctgtgattattagctaatcttttgcttcttagtttttgtttgtgtcaaaatttaactaggcttttttaaagaaaacatttgttttttaattaaatttttacaattttttttactttttttttttgagatgtagtctcgctctgtctcccaggctagagtgcagtagcacaaccttggctcactgcaagctccacctccttggctcaagtgattcttgtgcctcagcctcctgagtggctgggactacagctgcctcctaccactcctagctaatttttttgtatttttagtagagaccgggtttcacaatgttggtcaggctggtctcgaactcctgacctcaggtgatctgccgaccttggcctcccaaagtgctaggattacaggtgtgagcctctgtgcccgcctgtttttttgttttgttttactttttatcatataaatcttaaaatatgcaagatagaatggtataacaaacttggatatacctatcactcagctttagcagttatcagtatcttgccagtcttatttcatttattgcccatacagttgtttttgaggtggctcaaatattttaaatccaatcccagacctcgtatctcttcacccgtaagtactgtacttggtatctttaacagataaagacttgaaattacaatgttatcaagcctaacaaaattggacataattacttaatatcatccaataagcaggctaacctactttgatattttctcaattgccattctctagtctcgtttagagtttatttaagatcggctttactttttccttaaatgtttggaggaattcacagtgaagccctctgagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagaggtgatgtttttggtaaacaagctgggtaagatttgccgagttccttttactgtttgtaatctttccttagagcatacctgtgttggattaacagtataaataatagggtgtttattatattgtttattaatattaggctgtcagtggattattccggtctgatataagcttatgcagtggagaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttgctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgtatgagttccatacatctatctacattgtcagcaatgcttggtagtttagttttagttttagccattctggtgagtgtatagtggtgtcttgttatagttttaatttgcattttcctgatgagtaaagttgctaagcacattttcatgttactgtatcctcttttgagacttgcctatttttaatgatttgtctttttcttaatgatttgtaggaattccttatataatttggatgcaagtcctttgttagttatatgtgttgtgaatatcttctctcagtttgtagagaatatcttttcccaatctcttaatggtgtcattggaagacatgttcttaattttaatgaagttcagtttattactttttttcttttgtggctactgctttttgttgaaaccattatcttctccaagcttataaagatgctactctaggttttcaactaggttttacctttcacatttatgtctgatttatctcaatttttgtttaccttgtgaaccatagggggccaaggttcatttttcccccacatagctatccagttaacccagcaccatttattgaaaagatcatcgtttgtcctacctagtccttttaacatgtcttgaaactcaccactttctttttatttttattgcctgttgagttgttgttatttcatacattgttgattacagtagcagtttagattactcttagctgatcttcatgtccattctcctaacttcagtccgttatacacacaggtgctagaataatgtttctctaatgttatttttagtttctgttctttgttcaagaaataaaagtgattctgcatttcttatcatataaaaaatcaactcttggccgggtgcggtggctcacgcctgtaatcccagcactttgggaggctaaggtgggcggatcacaaggtcaggagatcgagaccacggtgataccccgtctctactaaaaatacaaaaaaaattagccgggcacggtggtgggcgcctgtagtcccaactacttgggaggctgaggcaggagaatggcgtgaacctgggaggcggagcttgcagtgagccgagatggcgccactgcactccagcctgggcgacagagcgagactccgtctcaaaaaaaaaaaaaaaaatcaactctccagactagttttcaaagttttattttccttattctctcttcctccaaattttaccaatcccaaactctgctcctgccaatataattttttcaccacccctaaagtcaaattgttcatttctgtgcctttgtacaaaccttctcttcctctttggaggtttctctctggtagttcctcataaaaccattccgagaagcttttagaatcagcaccgttgattttgttgtgtttctctctcatatcctatcaattatgcagacacacaatacatgtttctgctgttacacagtaaacttgctttttattcattttgtaaatgctgatttttttgttggtgtgtgagccattcagggcaggaaccatatattttacagtttctacagagaaccatagaattctccttacagtgttccctcatagacgtttaattaaaattgaccaattatattatataactgacaaggtttacataatataatttattttcattttagcagctgtattttgataaaaataagaattgctattatctcttcatgaacataaacaaatggttataaaatcagagagtttttcccccttgtatttgatagttatatatagctatatgtttcactgttgttgcgatgttatgtcctaggtgaaactgacttttctcttttctccattttatgtgtatgtgactttagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtaagcatctttcttcccttgttcttttggttatttttagttcttgatatgctagagagttttaaattattcagctttttagaactagacctttccttgatgagcagtagtgtcctttgataaaggacaggattctttgtctttagtaagacaaaattataattaatactgttcatcatcggtaatggggtatgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttcttttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgtttctgtacaagataaatgaattttaagggtgaccatcaatctatgaagagaaggccagaaaaataacaagtctattacaagactgcctacatagtaggtacttaactgtggtggaattagagaggcttttctagctagacccttgcaaaagagatttttgtcaacccaatgactataaagatgcccaacaacgatttatttaccaatatcattggagggctgacatcttagatatgaaaatatgtgttcccagagatgacagacacaaaacaactgcactctctgctgcatatactggcatcttctcttctactttatgaggagttttatgtctgggatttataccagccagtagaggttcatttactttttggctagcagagagtctaaggaaatagggttatagtcatatctctgtgggttgtgcattttactaatggaaaatcactgcttctagaatttatacattgaccaagctgtggactccagcttatattgacacaaatgagcacttctgttgtctttcttgggaatataagcaaatactttttatattcatatctttaatgattgaaactgactgaatagcttcctcatatgatcattctacttatattgctgtatagcctccttatagactccggagagtgacaaatatttaaatgttcatggaggctcctaagaatcccttataaaattaaaatagctcttccttttctgttcacattcaaccacaaattaaatattgcatcctcctcaagtttattacattccctggtggggaagcttagtaaaggtggactcattgaacctaaaaatgagaaacaaacttcaagggatagaggggagaaagaggccctgccttttcatgttgccagacccaggaccctgcttgacccactataaacatagaaaaaaagagacatgttactttcatttgactttgtattagctcatgccaactccaaaaccaatgggttttgtcatcatattttacatagctgcccagtcatctgcattagaattcctgcaagtattgtatcaaagggaaaagctgttagaacctgcttggattgtagtagccaaagttgcacacaggcctatttcctttttttttatataagggatattcttttggggatgggaaagttgttgtttttctaattggatttctaaatatgcaacctttgctagataggcccagttatgtttttatgtaactctaaattttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgagacctagagtctgcgtttctaacaaggtgacactgaagctgctggtccatgggccacattttgcatagtaaggacatagaatatcttgtgaccactgtgaactacttcagtttagtgtttgaactgtagctacctagatgctcagatacctttttctttttctctctcttttttttttttttttttggaggtggagtttcactcttgttgcccaggctggagtgcagttgtgtgatcttggctcactgcaacctcacctcccaggttcaagcgattctcctgcctcagtcttccgagtagctgggattacaggtgcccgccaccacgcccggctaattttttgtatttttagtagagacggagctttaccatgttggccaggctggtctcgaactcctgaactcaggtgatccacgtccctcagcctcccagattgctgggattataggcgtgagccaccacgcctggccctttttctcttgacttcagtagtaaacagacttctggaaagagggctcctcctctcccttaaattaattcagagggcaagaaacttattaaattattttgttaaagctctttcttttgccctgtagggagaatagtgtagctaggagtggtagaattcaacccaaacccctgtttaaaatatggccatagttagaattgtgtggtggtttgggaagcagcgtttaggttagctcagtgatcatttcaggaaggctatcaaccaggccactagactgttggttctatttttatcatgggtttctaacagaacctcacccatagaggccagtggtgtactgctaacaaagtattgcctggttcctgatgaccatatggttctcaactctatctgcagaattggtcccacataattaccagtttaaaaaaaaatactctctagccattgaaactataaagaaaaaaaatactatcaatacttgagtccaggagtaattaaataccacctctgggaggcaggacctagacattgctatttttaaaaagttacctgggttattttaatcttgcagccagtgttgagaacattaaaccaaatgaaattccaaatggagttaggtagagatgttaaaaactgatctctaagccaagacagtgaccgccacagaagaatcatattctcgagatcctctttggcacctcctacaaaaacagatatctctgactttacttttgttcttttccccctgaatatttttctgttatgatattctgtgaggttatccatcgtgtcagaagttgactggaagttgaatttgaccaatttagatatggtcgctcagtcccagggtcctttttatccttgcttacttgccataattggagaccgaaaattgagggcattttatattttggattgtctaaccattttctattcttctatcttaaaacttgatattcatgagaagatatttttattcttcctttttcatagcctggtgatcttcccttagatcttgttctgtttcatcttcttttactgtcacactcataaaattcggccagcgttaagatgtagtgagttgtgaccttttcttattaggttggagcaaaagtaattgcgatttttgccattaacagtatttacttttgctccaacctagtagaactgtcacagtcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtgacctgatgcccatgtgtataactcttgcatatgtgttatgtgctcatgagtctgacatctgcgaggatcactgaagtaataattgaatctcaattattttcttgcctttacttccaatctgtcagcagaggccttggctaaattacagccttttgttcatccaaggtgctgtgcattattcttttacataaacagtgctattgtgtatatcaaaaatggaaaggaagaattatccaaagtgccctttctctgtgctgatgaaggatttcatcctggagaaatatgctgtgtgcccagcttgagtggtatggaattgaagagaaactgccttttcctgaccctcagtccatgtttttcccactgtttctttcaggtttttacctttcagattattaagtcataagctatttattaatagttttgagattttttagcccacaggaaatccatcatctatactagttttgcatctttatttttcttcctttggaggagctttgcaatgacttaaaagtttagtttttagagtttgtgttatgtggaaagatctttgtaagttgttgcctgttaaatttctcagtgaggcttccataaccaccatctttgtatcagtgcatacgtttagtcaaggctggcctcagacagttttgagaataattactaatttctgagttctagtccctgtgctagaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaatacagcttgcttgccctgggcctcttgatggtgtacatcccaggtccctgagtatatgagtttgggttaatgtgtcacatgaaagttggagaaggactacagaagtgtgttcattcatgaagaaaagagactgaataatgagtaagttcatgcacctttcttgcagcaagaggaacagattgttcatcttatccttatttatttatttaaagacagggtcactgcaaccttgagctcctgggctcaagtagtcctcccacctcagcctcccaaagtgttaggatttacaggcatgagccactatgcctggtcattttattttcatttaagtaaaaccacaaaaatctccgtttcccatctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaagtagctgggactacaggcacatgctgcacacatggctaatgggtgttcattttttttcctcagttggttctattcatatgtttgtcaatgttgatgcagatattgtgctctaagtaaacaattttgtcaggcttttgtccttttggtgataattttccctaataaaatgattcacttcaagattgtctcccaggaaatactgccagtagccatatatatattactgccagtagccataaatttatatttacgaaacattcattcattcaataagtaaatatttgagtgcctagtattcaggctctattctgtgtactaggcatatagaatggtccttgcaaccttacgaaacagtccttggaagcttacattcgcgtaggggagacaaatgataaagtagcaaatgctgtgaaacaaagtgagacagaataaagaggttctcttgttgatttttactatattcatcattgagttctgtctgacctaagagacctgtggtgaccattctaaggactttttgtcttacatcaggaagtaatccgttccatccccctacttttccactgatagaagccttttcccccctcaggttatggagtcttctgatgatttttatatgatctcaatgcgtttatgctattccttatcaagtctgctcttagccatcagtttattagcttttgcatggttacagagtctttccaccaatttgattaattatattttatgatgctttttggaatagctttttttttttttttttttgagacaggatctcactctgtcacccaggctagaaagcagtggcactatcacgacatactgcagccttgacctccctgggcccaggtgatcctcccaccgcagcctccgaactagctgggtctacaggcgcccaccactacacccagctaaattttgtattttttgtagtcatggttttgccatgttattcaggctggtcttgagctccggggcccaggcaatccacctgcctcagcttccgtaagggctgggattataagtgtgagccactatgcccagccttgaatagctttttgaagatcatattaaaatttgcagcctagtagctaaaaaccatactttaacctacaagatactgtgtgccatctaaaatttaaactctgttagaaagacacacactgatggttttgataccaataggattttgacgatagttaagttttattgtttgtgaagggaatcattgtatactatttttgcaccattctgttgactcctgaataatagagctattggtaagctatatggcttggagcattccttagattcccttcaattcagtaagttctagaaaacagtaaataaaagagacactagctctaaacaggagcatagaaatgtctgagcttaagatatacacctgcagttaagagaatgtcttcagatacctagacagctccacagttttagaagcaaacagatgtactttggactggccagacataggtcaaaggggctaacccagatcagtcattatgataatttgtgggattttttttccagtccgctcagtggttatctcagatgatattcctttataaaatttaaaaattccttttcaaattttcttttcttggagtcaggcggatttattcccctatataacttcaatcttgagttccttctctgtatttctgctgttgtagcacattgccattggacaggggcatttccttttgttatctatagctgaactgagcctgtatgcaggctcagctctgagacttttggctctacctggctctacagagctcatgtaaccatgccgaaatccctttagcccataagttacaataagtcaccataaaacccctgttttctgtccagttactgaacattattgtgcaatgacacattattgtgtagtttaacatgaaccaagttccactcagcattacttcagatgtggtaaagtgaccactctttggcagtagacaaatgttagtattattctcagtgccatttaatgagtacagcaattatgggggactacaccactagcagaaaatttggatttaggtatcagttacagttttttaatacagactgttcaattctcagtatttgaaatattcttttcctgaagttgccgtctttcccccttctttctgtatctgatttagttgacctataattgacatcattttcttcatggagaaaatggcagcctcagtaaggcaatcctgggaacaatagtgagtggacacctccaagagacacttaaaacacagtatctagacatttaagatcaggatcaaagccataccctgcactcctattccttttccctcctgtctcctaccagctcactggataacagatatcactctgagttttacaagttctagtttgattgattttgtaccctacctgataagtatgggcttagagtatgtccagacagatgaacctgaatcccaataatctcaggctgggtgcaatgattcatacctgtaatcccagcacttcatgaggctgaggtgggagaatcgcttgagcccaggaagttagagcccagcctgaacaatgaagtaaatttttttctttaaacaaatagtgtccaactgaactgaaatagctactgtctagttcaggctgatatacaacaactttcttgtgtagttgttcactttctagctttcttttttcttgatgagtatctccttcctcctgtttatcacttgtagataggagaggccactcactgggtaattcgcttccattcctgctgacatctccctattagtcactcacacccatcatcatgctgtcaccttgccatggtttcagagagtaggataatctccattagaatatttttcagttaagagggaagttgctgaatagtccgcataagctgtagtcttgctagttagaaaacatgtatagtattgaaattgtcctttccctttgctctctgaacatagtacaattaggtgaacctttgtatccctggctgtgtctctgatatcttttggaccctgtctttgtgtcagatcagagttcatgtttctagctgagttgtatctgatatactgaacataaacagaggaatgtcaagattgcttttcagttcttcatgattttgaataaaattgacaagcactgggggacagtactttcagatcctttccagctaagataatattcatatatcattcaacgataaaaagaatgaaatctaagaaaataagggctatgaatgtgctttctttcctttggtctaaacactacccatgaatctcttttctcaatgccttttattgaatttagcaaaactgctgtttcctttccaatgtgtttttctttcttgctgttctgtgccaagcaggttcataaagaattctatctctttgaatcttggattataagcctagccagaagaggggagaataagttgcggtgagagggggtaagcccatcagaaagtcgaaaaccacctcagagtatcaggacaaatgaaacatttttcgtaggatcctttccatgggttttcctcgctgctcaaattttttttttttttttttttttgagacggagtcttggtctgttgcccaggctgtagtgcaatggcatgatctcggctcactgcaacctctgcctcccaggtttaagcaattctcctgtatcagccttctgagtagctgggactacaggttcccgtcaccaggcccagctaatttttgtatttttagtagagacgggtttcaccatattggtcaggctggtcttgaactcctgacctcaggtgatcaaccggcctcagcttcccaaagtgctgggattacaggtgtgagccaccacgcccggcctctctgctcaaatcctgacttcctttttattcacaagttccaaagtcatttctgagcagatgaagtcttgtctgactctaaataactgattctctaacggcagtgttttcaaccttggctgtacattagaatcaactggggaagcttttcaaaattctgatgcccaggctacaccccagaacaattaaattaccatctctgggggcgagtactttttaaagcgctactctctgcaacccccacacacagatggttgattccattgtgtatccaaggttgaaaccatactactgaaacataattgacatagttattagtattcttagaaagcttagtctaagaaacctccaggtttttatgaaggggaaattaaaaaattaaaagacagcctttgcaaacttattttgtatgagtatttttttaaaacacatatcaaccctgtgttccagtctaactggccttttcattcttccatgctttcttcacctttgttcatgctatttgagaaatggccttcccccatttttgctttttataattccaccctaccacctttttgaagtttctcttcattctttcagccagagggaggttcttcccttcagaacttcgcttttttgctttagtatattctgtatggttttgcatttgtgttttatttctccagctagtttgcaaagcttcattcttatctatgtagtcccctcattgccaggcatctttatatcccttgtaatgccttgcatccagtaaatgttatgtaaatgtttgtttgaataaaaggaatttcagacgtcatgctgcagatgtgtgctatgatagaactagggagaaagcagatgtgtaatatcttttctattcccttcacacttttctagttactcaaattcttggtttggggatgcctttttttttttttttccgagatggagtcttgctcttgttgccgaggatgaagtgcaatggcatgatctcagctcaccgcaacctccgtctcttgggttcaagggatgctcctgcctcagtctcccgagtagctgggattacaggcgcctgccaccacagcctgctaatttttgtatttttagtagagacaggatttcaccatgttggccagggtggtctcaaactcctgacctcatgatccgctcaccttggcctcccaaagtgctgggattacaggcatgagccaccacgcccagccaaggatgatctttttatttatttaagtatgtgattttcatcccctgtgcaaccattaagtagtcttcaggaatcagattctggaaatgttagctctggtttggaatgcttatagtttacaacagagcatgcttgctaatgccagttatgaagcacctaccagggttattttctttcatggtttaaacagaactttgttgtagtcgtcactatttttcaatatttaagattaatttttagatttttgagaatgccattttatgtactactctctgttcattgagaagataaatcctctttccccaatcttaaagatacaaaataatttttacagctcaacgacctgcaactttctaccactaaatgactataaaggagaatgtgcttagagcagacaaggcatttgatgattcaaggaagtgttttagatgcacagtaagaactagggaagaaacaactgtggaactgtagcaaaaagtagattttgctttttaaacagctccattagttgtgtttatgtgtgttttacattgcctatatgccacctattttcagcttgagttctttaatgtttttgtcaaggaagaccgacttcagagtgaattatatctatcagaatcctgagaaaaaaagcaagactaagaccatgtggagttattttcttgtcagctaggtaattcagttagtctgattctctaatgcgtaacatcctttttaaatgatctccaaataaatccacatttctccttagtagaattgactgtgaaagagatttgaagcactgcatgcttccccacttcctccttagatagttcagatattttcttttttaggaacattccaaactctaaaaatcacttttgttccacctataatttttgcagcttgaagttgcagctcaatactagtttggctcttactttttcagtggggcagcaggttttgtaaattaaaacacattaattgttttgttttttggcttttccttttccaacacctccccaccctttccgtccgccccccactataagtttccttttaaagaaaaaataaagcatattcgaaatattgccgcttggggatagagcgtcttagaatatgcaaactctttaaatcttgtttgggtttgtgcctgtgtaccccagtgcaaagattggatctgaaacatccctgagatgtcccagctccgtcttctttccaagttttctccaaactgatacaccatcactaccaccacttagttcccctagtacatatttctttgtaatctagaatttttttaggctttgggagacaagttgaatggcatgtatttccagcaacttggtagagcaatttacagattctatatgggcatctagtatttagctaaatgaactctacctctctctcctctctctcctttctctctttcagcttggcagtgaccttggcgggggcattggaggaagtccggcagtaagtgccatctgtttttttcaccatgagaagcactgccccctgtttgatgcctttcctatgtacacattatcagaccagccactgctgctgtctagcactgcacaccaaaacctctataacagtatatgggtagtagaaagtagtatagggttacttggaattgttggggtcatgcaccacatggtgtagagacatctttaaggtttaatgttccagtgcctatagagatctttgtctttctgatattaaagagctaaaggaaatggacccttccatcttgactggagaatgcttattccctggtgtcacctagaaagaacttgagagggtcagctggactcagagtgagactctcctcgtaaatgagttagtttcaggggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttcttatcaatgatgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccaatttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatatagtcttacctttctgaggaccaatttggctgaattctctgctttctaatctgactccttatgggggatccctgctatagagatgtagaccagttgtccattccaggagttgtaactgtgataactgagtgtgtatagttattacagtacatagcaaaaccgaagatattcaaaattgagccatagtgttttggcacaactcggtagctttgttgtaaggtttactatatgggatattatcttcagacttttaattattagttatctaatgcactcatttactaacataaaagtattgtatacaaatgaccaacgtaaataatgtaaaaatgtaagaaggaaaattgtctccccctgcccccatttcccatgtatagccactgttaactttcttgtgtgtcctttcaaaagaaaaagatcatgcccatagctgtatatttgtatcctttgaacattccgtgtcagtgggatatactattttgcaccttggtttttctctaccatattcttttgaatccgtatatctactgaattgatacaccataatttatttaatcactcctctgttgatgaacatttaggttattccctggtcctccccaccacctgccactcttttagtatggctgagtacattatcatgattattcaccacccacagatcctttggtattctgtcttaggtggtcagaacagctcatgactcctgatttttttattttatttttttttagacggagtctcactctgtcgcccaggctggagtgcagtggcgtgatcttggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgagcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttctttatttgttaaaaaatacatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactggttaaaaactcacatattgggccaggtacagtggctcatgcctataatcccagcatttgggaggccgagacgggctgattacctgaggtcaggggttcaaaagaccagtctggccaacatggtgaaaccccgtctctactgaaaatacaaaaatgagctgagcatggtggcaggtacctgtaatcccagctactcaggaggctgaagcaggcaaatcccttgaacctgggaggccaaggttgcagtgagccgagattacgccaatgcactccagtctgggcgacagagtgaaactccatctcaaaaagaaaaccaaacctcacacattggcagatgctgtatgtagagtgagccctggctcttgcaagccttttcagttatcagcttcaactctggaggcactagggagtttgttgggaaactcatccaaatgcgatgaagaaaccagaacttatttactatcttggattctaggattagaacgtttttgataaatttttaactgaaatccatttattcattcaacaaatcattgtttaacattagcatgagccagacatttctaggtactggggctagagtagtgaaccaaacaaagctcctgactgaaagttcacattttggtgggggaaattagcatatttggttggtataagaaatatggaagtatatatgctgaacaaataatcacataaaccttgacaacctccttttagcaatgaattctctgccttaataaggaagagagcatgaagaagtaaaatgttaatgtcttattctttttgaaacatcagtgggttttattcagttttatggttcaggaaaatggctgttagaccttaatggcatgtccattcatttgtaaatacaggatatttagccctgcatataaaaagtagtaattggacccttaaagcagatttcataaaatttgtcaatggcaatttgcataagtgactgtctgatttatttctcatcatttggaaacacttttgtactctggatttgagagcttggcatgttaaaaatcatttaactatctagaaagtctgtgtttctttctgtcaagactaccaatgtttccagccatttttgaggagctggccctgttaaaggccagggctgttgggaaaataaataaataggccaaggctattggtggaattctgttgtaataaaggaaatctgcagatgcagagtctgcattcatctctagcctttttttttttcctttttttttttttgtggggggatggagtcttgctctgttgcccaggctggagtgcagtagcacaatctcggcggctcactgcaacctcttttgttctgttccattgttttgtttttgtttttcttctttggggttttcaattattcatttattgactctttgtttatcttttatatactgtttttctctctaatcgttaaaaaaaatcatcaaattcttttatatcagcaaataaccaattagtgtcagattttcacagttgtctaatgtttttgtactgtttactttgtctgaacagggtcccaataaggtcccatacattgcaattggatgataagtgccttaagtccctttaaatctataggttcctcctcctcctctgttttgttccttaaaatttatctcctcctccttctctgttttgttccttaaaatttatctgtagaagaaattaagtcttttagtgtggagtttcccacagtctcaatcttgctgattctacctgtaaattggaggcagattatagatttaatcagatttaggctcatattctggcagaaagccttcataattggtggtgattgcaaatcctgtttctcttttagttatttatttttctttttctcattttattctctatgtttcttaccatgtttactatgatgtctgtttccttgttctttgtaagtcagtctttttgtcactataattgtaccttttctataattttttataaatgaaattacataatatggaatcttgtatctggtttctttctattagcataatgcttttgaaatgtgtatatcagcagttgatttcccttttgttgttaagtaatactccattgatgaatatacagtttgttgacgtgctcacaagttgggggagtttggttgttttcagtttcatctttatgataaagttgccatgaacatttgtgtatacatctttggttggacatatgtttttgattttccttggtaaataactaggaatgttattgctaggttatatggtaagcttgagaattccagatattccacatcctcaccaattttagccattcttgtcgctgtgtagtagtgtctcattttaatttgcatttccctaatgactactaattttaagcattttttaaaataagcatattggtcgttcttatatctttcacttaagtatcagctcaaatctttgccttttgttgtttttggggggagagagaggatcgtcttattatggagttgttaaagttctttgtatattctggatacaaatcctttattgcaaatattttttcccagtccatggcttgccttttcttaataatgttttcaaaaaaaaccaaaagggtgtttttgtttgtttttttgtttgaaacaaaggcttgctctgtcacccaggctggagtgcagtggcacaatcaaggcctactattgcctcaaattcctgggcttaagtgattctcccacctcagcctcctgagtagctgggactacacctgtgtaccaccacacccagctaatttttttatttgttgtagagatggggtcccactctgttgctccagttggtctcaatgtcctgggctcaagtagtcatcctgccttggcctaccaaggtatgggaaatacaggcatgagccactgcacccagtcgaaagttttcaataaagtcaggttcatcagttttttttcttcttatgacttaggctttttgtgttctaagaaatctttgcttaaccccatggttacaaagatttttttggcatgtttttaaatataagccttatagtttttgttcctacatttagttttataattcattttgagatcgtttttaaatatgttgtaaattaagagtcaatgtaaaaactttttccgtaataggtcttgaaatcagatggcctaagtcctgcaactttttttcttttcaaagcttgttttggctattcttggtcttttacatttccctgtaaattttagaatcagcttgtcagtttctacaaaaaaaatgctgagatttttattggaattgcagtgaataagtagatcaatttgagggagaattgacatctaaacaatattgagtcttctaatccattagcatagtatatctctctgtttaggtctttaatttctttttgcaatgttttataatttttttatgcacaaatcttaccttttgtcagatttaagtatttcaaatttttgatgttatagtaaatagtttttttttttttttgagacagagtttttcgcttgtcacccaggctggaatgcaatggtgtcatctctgcccactgtaacctccgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgcccttggcctcccaaagtgctgggattacaggtgtgagtcactgggcccagcagtaaatagtatttttaattttaattttttattattgctagtatatagaaatataattgatttttatatattgaacttgtttcctgcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgatgttagccataggtttttcgtggagcttgaggaagtttcattctgttcctggttttctgagttttattatgaatgggtattaaattttgccagatgcctcttctgcatttactaaaatgattatgtgaacttttttagtccattaatatgatggattacatcagttgacttttcaaatgttaaaccaaccttacattcctgggataaatcctacttgtttaggatgtgttgtctttttttgtgtattgatggagttcattggcagaaacttttttacatctatgttcatgatatatttactcttcatttctgatatgatttacttttttttattatttctttcctgagttagattggctccctttaccttttcctgttgtcttgccctcacctcacattatctggtcatcccttccccagatgttttcttttactgttgtgtggtcttccttggtagctagcattgttgtttgtttgtttgtttgttttgttttttcaagtatgttttgtttgtcattaaggaagttgtactgctgtctttccacttttttataatagggctttgaacagttgctgtgttttttaccattatgatactcatatttgaatgagttggaatttgcaggactagctattagtagacttctatagaaaaggaagctaggcgggtagttttttagactttgctcctcaagaacgtttccttctttgctctggtgtagccacagcttcttagcctctctgaatctaacttgattctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattacaggcgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaattttataaacgtcgtagtcccatcttccatcatgtggctatttagaatataaattcaatataaatttgtatcattttgtttgttatcttctaggccaattttttctttctgcttcatctttataaaattttgttttcttcttttttttccacccgaaacagggtcttgctcttttgcccaggcatggtgcagttgaggctcactgcagcctcaacctcctgggctctcaacctcctggactcaagtgatcttaccacctcagcctcctgagtaacagggaccacaggaacacaccaccacactggccaatatttgtaatttttttccagagacagggtttctctatgttgcccaagctggtcttgaactgctgggctcaagtgatccactcgcctggcctgggtctcccaaagtgttgggattacaggcatgagccaccatgcccagtctatggttttggtttttttttttttgttttttttttttttttcagacagtcttgctctgtcgcccagcctggagtgcagtggcacaatcttggctcactgcaacttccgcctcccgggttcaaacaattctcctgcttcagcctcctgagtagctaggattacaggtgcctgttacctggctaatttttgttgtatttttagtagaaatgttgtttcaccatgttggccagcctggtctcgaactcctggccttaagtgatccgcccgctgcagcctcccaaagtgctgagactacaattgtgagccactgtttccagccccagcctataaaattttatccttatgcttctcagaccatctgtcctcccacatatgtatttgttttctatttaacttcagattcagactgagtttcccatctctttaccattcttatattattaaacaagttttcctggataaaactggtagctattcattgcctgcctgaagcttagaaagtggccatgtttggctctacaacttatcctaattgtttggaatttataagccagtcaatgccacttagactagctctttcccagtgattgtgtcctatgtaagtgaaaaaaaaaggaaagtgagaattaccagtaaataatcctctggacttatcagtcaggttatcaagcctgtaaaataatttattatacttctctttacagagtagaaattggttttcgtttttgtttttgtatttttaaagacagggtgtcgctctgtcatctaggctggactgcagtgatgcagtcacaattcactgcaacctctaatgcctgggatcaagcaagtgattctcctacctcagcctccagagtagctaggactacaggcgtgtgccaccatgcccagctaatttgttttcttttattactttttttttggtggggggtgggcagtaaagacacggtctcattatattaagtgaccctcctgcctcagcctcccaaagtgctgggattacaggcgtgaaccaccacacctggcctcagggtggaaattcttaattcttctttctcccaagaattatctaaggaaagatttattaaaaatgatattcatcaaacctgccctctagtgacgttttaaagagaaggaactttcagagttatagcactagcaaagcagttctgcacttaagaatattttctccttcctcaaattcatttaatggaaaacagaaaattatgatgtaaccagtgttatagcaaattggcattgagcaccttgattcctgctatcccttttatttaattgtattaaaaattttgtttcctcacctgtaatcccagcactttgggaggccaaggtgaccaaattgcttgagctcaggagttcgagaccagcctggccaacacggtgaaaccccatctctactaaaaatacaaaaattagcatggcatgatggtgcatgcctctagtcccagctacctgggggactcatgtgcgaggatcacttaaacctggaagttgagggctgtggtgagctgagctgaaatcatgccactttgctccagcctgggtgacagaatgagaccctatctccaaaaaaaaaaaaaagtttcctttaaatggagcaaaatgccattaaaacccaaagatatggcaaaatcctgcctctttttttttttttttttttttttttgagatggagtttcactcttattgaccaggctggagtgcaatggtgcgatctcggctcactacaacctccgcctcccgagttcaagcgattctcctgcctcagcctcccaagtagctgggattacaggcacccgccaccacgcccggctaatgttttgtatttttagtagagacagggtttcaccatgttggccaggctggttttgaactgctgacctcaggtgattcacccacctcagcctcccaaaatgctgggattacaggcatgagccaccatgcccagcctaaattctgcctcttgattaacctctgtgatttatgtatcctctcttctagctttggtgtcatccccagcactcctctggccatccatacaccactgatgccaaaccagagcattgatgtctccctgcctctcaataccttgggcccagtcatgaagatggaacctctgaataacctccaggtcagagatttacttcactcaggtggtacaagttaatatcttgacaattattattattattattatttttaaagacacagtcttactctgttgcccaggctggagtgtagtggtgcgatcttggctcactgcaacctctgcctcctgggttcaaatggtgctcctgcctcagcctcccaagtagctgggattacaggcacaagccaccacgcctggctaatttctgtatttttagtagagatggggtttcaccatgttggccaggctggtctcgaactcctgacctcgagtaatctgcccacatggacctcccaaagtgctggaattacaggcatgagccaccgcgcctcgcccaatttttcatttacatgtaaaaaagtccctctttcttccttaggtttgagttagtcatggaatcggatttgaaataaatctttgtggacgagagttttatgttttgttgttaagaaaaacaaaagtcatgcatgacatagatattcattcttttactcaacaaacacttagaaacttttttcttaacttcttatttgtaaaccttttttccttaagacttttatagcaaaatttgaatgtcattaatataagaagagatttatatggaggttatcattgaacattggaccacaggtagctaggctgtttggatttaaatgccccattagcacctatctatgataagtataacagcatcttagaagaattttatgtggtctacaagagcctctttatcttgaaaatgtcgaattttttagaatgcttgggtgtcagcttagagtttcattcagttttcacctacctcgaagtttcctttgaaatataaaccttctgggcttcaggcaacatgaaggcagagcagtaagctcataagtcagaactgtagcaaccctggaggttgctagcggttatggttttaatgttcacaagaacaggaagaaagccttgggccacccagaaatggggaactgtaatcgatccctgcataaagcagagaccctggaagggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactatgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttggctcagacaagaagaataaagcaaggattactatgcagatggaattggctgttactatgatgacagtaatgtgttaaggggcttttccagcacaggatcctgaagaaacttaacccaaatctacatctgttcccttttcattgaaatctaacctcccattggccacagagcctcaagcctaatatttgaggacagtcagcatgcacgcaagaatgctttacctcataagtaggaaagagaatttgggtcacagaaaccagggcaaattttctgctcttaaaatgaaaagaaaaaaaagaaaagaaacagtaaacaaattaatgaatgtcagtttactttcctgttggcatttccatttgactaactcctgaacaggaaccctcacaagagaagttgaatcttagtccaaccctttcctcaaaagtattgatgtgatattagaactagcaagttttaattttcataaacctgatattataagaagcaaactttaaatttttccatctatagttaactactgatttttcaagtttcccacatggattctcttcttttggggatgtcataattgtggctattttctcattaattggcatttcccaatggatatgataaacaaaacttgaaaagagaaaaactttttccccctgtgagcagctctacttagtgtatgctggtgagagttggaactaatgtaatggctagcttagggatgtgtagggtactttagatttcagcttccattctgcccttttccccgtatgaacaagaagaaaatcaaaacatcattccaacaaggttaaactatatatacatccagataaagccaggtaaagattgatctagcttttaaatatatttgtataatgtttagattcaagagctcatgtgggaaaattagtatttttctagtactacagaccataaaattgggaaaaaaaaatgttggggattgaggaaatgaaattttgaattccatgtggattttagctattttggctaatttaatatcaatgtgtagaacaattaaatcaagcccagctgccagaactgtagtataaaacttattataaaaacttttcatcagaacactcattaaactacttattggcttatagactatttgaaacactatttaaaaatttaaaagataccattcattcttttttttttctttgagatggagtttcattcttgtcacccaggctcgagtgcaatggtgcaatcttggctcactgcaacctccgcctcccaggttcaagcgattctccagccttagcctctgagtagctgggattacaggcacctgccaccacacccagctaatttttgtatttttagtagagacggggtttcaccaatgttagccacgctggtttcgaactcctgacctcaggtgatccacctgcctctgcctcccaaagtgctgggattacaggcgtgagctgccatgccctgcctattcattcttaaaatgtaaaatacattatgccttaaatatgggaattaaatacctagtagagatttgaacctggaagaatttttctactatactgacatcgactgtaaaagcttttgtgaatcagcttataaacattatacaaagtaaagttaagcttgctcctactgggagcctttcttgagtttatttatatcacgtaattatattccttaaaaagagaattgattctctctgtttaaatacagcagaaaccttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcaagttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggctaacacggtgaaaccccgtctctactaaaaatgcaaaaaaaattagtcaggcatggtggcaggtgcctgtagtcccagctaattgggaggctgaggcaggagaatggcgtgagaatggcgtgaacccgggaggcggagcttgcagtgagctgagatcgcgccactgcactccagcctgggtgacagagcgagactccgtctcaaaaagaaaagaaaagaaaaacccagtcctgagacttttctccctaacaagacctccaatatctcctcccacaaagccaatttcgttcacctcttttgataattacctaaataacatgctcatattgggactcctggatttttatttatttattttttttgagatagggtctcactctgtcacccaggctgatggtgcagtcatgagacactgcagccttcacctcctgggctcaagcaatcctcccacctcagcctcccgaatagctgggaccacaggagcacaccactacacccagctaatttatattttttaaaattttttgtagagacggggtctctccatgttgcctaggctggtctcaaattcctgcggtcaagcaatcctcccaccttgacctcccaaagcactgggattacaggtgcgagccaccacacccagctggatttttctgttttagatattcctgtacatgtccccactcactgccatcatctacatacttttcatgttcccattttttctgacagaactatcttaaaatttacttaaatcagtgttcaatgtttacatcaatttttttttttaagagataaaatcttgctcagtcacccgggctgaagtgcagtagtataatcatggctcattgcagcctcaaactcctaggctcaagcgatcctgctaccttaggagaatctcaagtagctgggactacaggtgtgtgtcaccacgcctagctaattttttatttttatgtagagatggggtctcactgtgttgcccaggctggtctgaaattcctgggctcaagtgatcctcctgcctcagcttcctaaagtgctggaattacaggtatgagcctccacaccctgcccagtgtttacattattatgactgcatatattctttgaagctgagccatatattaaagtgatttttcctcaataaaactttttgtagataattggagttaatacccatttatgttggtgtttttaactgtaattcaatcccaaattccattgagatcagacccttcaaagtatactattggtttccctttcttaaagtctcttctagactgatttacttgaatgcctggaacatagctgtcttcctgggacctcctttcatcttaaccctggagattcattcccttcatcagctctctcctactcaggatctcctgttatagtgtccttttcttggtttactccctcttttgatgaaacacattttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtcttttcacccatcatgctgggtactcattgggttctttaaaaccggaaactcatgtccttcaattctaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaatacaaaaattagccaggcatggtggcacacgcctatagtcccagctaatcgggaagctgaagtaggagaattgcttgagccagggaggcagaggttgcagtgagttgagattacgccactgcactccagcctgcgtgacagaacgagccacaagcctttatctcaaaaagaaaagaaaaacacttttttatgaaacatttttaacattgcagaagtaaacagaatagtataacgagcccctgtgtacccatcatccagcttcaataattatccatggttaatatcatttatacccctttccataaccctactctattgtttgaaacaaatcccagacatttatatcacttaatctgtaagtattttagtatgtctcgtattttgtttgtttgagatggagtctcgctgtgccgcccaggctggagtgcagtggtgcaatctcagctcactgcaacctctgcctcccgggttcaagtgattctcttgcctcggcctcccgagtagctgggattacaggcacgtgccaccatacctagctaatttttgtatttttagtagagacggggtttcaccatgttggccaggctggtctcggattcctgaccttgggtgatccgcccttgtgggattacaggtatgagctaccacccccagctcagtatgtgtctttaaaataggtctcttttaaaaaatttaactacaataactattctcacaacttaaaaaattagcaagaattccttaatatcacatatcgaatcaatgttcagattttgtcataattttttttgttttattatttgtgtttgaatcagtaaagtgcacatattatggtgggttgatagctcttaagtctctttagctacactgtttaatatgatagccactagccacatgtggctatgtacattgaaattaaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgtatgtagttgtttttcttgtatttctctggcttggagctcactgagcttggatctgcaagttgatagttttccccaattttggaaatgttttgtcattcttcagattttttttctgcctcattatgtctcttctctccttctagaactccagttacatatgtgttagactactggatatcatccctcagatcactgaggctgctttttttaaatttaatctttttttctctccgttcttcagactggataattcctattgatctgtcttcatgtacactgcttctttcttctataggcaacaaccttctgttaaactaatccagagcattttcatttcagatattgtactttttaattctaggatttccatttgattttttgctgaattttcctcactgggctggctcaattctttccaaagttatctttaagtctctgtctacgatagaaaggctttctgcaagccttgtggggagctaaattgggaaagagggctggagagtcttagcattcagtatgcattaattcatttaattcaccacccctcagccatgtctggcttttacttctaagtgccatctattttatcctctctaaaagaatcaatcttcagttttgtgcagggcctagagacctaagagctgtccagcagtatagaatcggggttggtatctagaaatcctattgacatcttaatcctctcgtttttaacactcccctcctctccccaccatacagttccagaggtgctaccagtcctaagcctttgagaattctgtggtggtattgctaatccatctgttttccaggtaccaagtttttgttgctgttatatctttttgttagtatctctatgaatttataccttgaaaattttttattttcccttagttatggcagaactttttccaggagaaaggaaacttaaatgtgatttttcagtctactgcctctgcctagaggtctgatagcaccttaacattttttctttccttcctgcgatacaactttataattaggaaccttagaggtgaacctgtggagaaagaattgaccctttcccatatatagtttttgttgtccctgtctttattgcctttaaatctcacataaacattgtcgaataagaggctgaatattaattagagaaaagaaatagacacaatgtctcttttttttttctttgaatatctttctaaaacaaggcaatattcatcagtctgttcatgtaacctttgattagggcagaaagtgctgaagacactagctgcaaaggacacgatcttacagtcctgtttattcatgtcttaagatcattgtcagccaaattttgctggtatatggctctgaggaaattctgtcccttgctactcctacatgtagttccagcctgtgagacagtcagttgcagatggtgcttgtccctgatatttcatgtcttgcatatgtccgttcacactcagaaagcccacagctatagctattgtaccagaaaaactggtagacgcttccaagcggaagaccttttcagcgctcccatcaaatgaagcaaaccagcttggcatttgctgacgtttcttgactgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattcccacgtcagacagttggatccagcgttggatctactatccaaatgatccctgtagacctaaaaatattccacctaaaatattccataagcagtatgtaggtactggagtcttcattatgaaagattaaaacattttgctgtcaaaaaataaaatagaaaattacttactgtgattgctacttccagtttgacatattcttcatgtcccatcaggactataaacatattatttaatctcatctgagaaattcaatatattatgtattagatattccttttttgctagattgtccttagtgagaacactcctttatctttttttatcaagataatcgagagtctactaagcagtatcttttgtctttctgtaaccagcactcaactactggtttctgggatcttttagcagtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagatttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtttcaaaccctatctgtttttgatggaattccctctttcttggcagtgatgggaaaatcagtgtgtacatgaataccaccagtgatttgctactctaaatgacccattctgtcttcataaaaccctgttacggagttgtttatttggcgtttttttatgtttgttttctttggcgcggggcggtggggggaggggcggtaaattggagtctcactctgttgttgcccaggctggagtacaatggtgtgatctcagctcactacaacctctgcctctcaggttcaagtgatcctcctccctcagcctcctaagtagctgggattgcaggtgcctgccaccacgctcagctaattttttggatttttagtagagatgaggttttttcaccatgttggccaggatggtctcaaactcttgacctcaagtaatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccctggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttttacccctggattgaaaaatcagttatgttcattgataccaattactgcctattattactgaagtttgttcttttattgaatttctactaggtcttctatgacatattaaattagagtggaattttaatcactttaactgatagttttctagtcttgccttcacgattttttgattcaatacagtatgtattaaatgcttttgtttgttttttttcagtcagggtcttgctcaacttcccaagttggagttcaggggcacaaacatagctcactgcatcctcaacctcctggactcaagtgatcttcccaccttagcctcccaagtagctgggaatacaggtacatgccatcacacctagctgacttttttttttttttaattttttaattttttgtagagttgaggtctggctatgtttcccaggctggtcttgaagtcctgggctcaagccatccacctgccttggcctcccaaagtgctgggattacaggcatgagccaccgcacccagcctaaatgtatttttaaagtttaacagtaaacccaggctgagcgccatggctcacacctgtaatcccagaactttgggaggttgaggcagttggatcacttgaggtcaggagttcgagaccagcctggccaacatggcaaaactctgtctctgtctctacaaaaatacaaaaaagttagctgggcatggtggcacacgcctgtaattccagctactcaggaggctgagacagaagaatcgcttgaacccaggaggcggaggttgcagtgagccgagattgtgctgttgcactccagcctggggaacagagcaagacttcatctcaaaaacaaaaacaaaacaaaacaaaaacccagtaagccctacatagcaaataatagctcaagttgtgcctctgcccccctcttcccacccctgactattaacataaacaatattcgaagatgagacagcagcaaccaagggcacatcagccagtacatgtagctgtgtagctatcattaaagggaaaaagaaagactggtccctttcggcttatctgtcaggcaggctgaaaggcctgtgaaattattgctgactgtttctggcaactggaactatatagagtaattctattgtaggctgctagaagaggagaggattaggggccagtaagatttctgaagagtaactgggttgatcaatatagtatcacaggtgggttatacattggcagaaagcagtcacatatacatttgctgtaagttctggatttattttatttaacttataaaactttcaaaatgagggagctacccaggagtaggaacagatgcagtgtatcttagcatgattttcccttgatcctgggttccctgtgaggcacacagctgccagtgacataggtatgtcactggcatacctatgtcagtgactttcacatactggtgaaagttgcttaattcttgctataccactggcctgttccattcaagtaaccctcaggtaagttacctgttatactcagatatctaacttatagcaaatgtatatgtgactgctttctgccagtgtataacctccctgtgatactattctgaccaatcttttttattggcccctaatcctctccacttctagcagcctacaacagaattactctatatagtttcagttgccagaaacagccagcaataatttcacaggcctttcagcttgcctgagagataagccgaaaggcaccagtctttccttttccctttaatgatagctacacagctacatgtactggctgatatgcccttggttgccgttgtctcatctttgaatactatttatgttaatagtgggggtggggtggggctgaaggacaacttgagctatttgccaagtagggtttactgttaaactcaggtaaccatgagtataactggccagtgctatagcaagaattaagcaactttcatctgcccactcggaagagcttgcattaacagtttctaagcagaaaaggcaaaatcctaccaaaggtctccaagaccttgggtgatctagctatgcctttccctccctcctttcctcattaacttcatctgctactcctcctcttcactatagccattctggtctcctcacttatcttagaatagggtatgctgccacctcatgaccttttaattgactattgtccttgtctggaatgtgccttctcctagtctccatatcgtatagcttacttacttactttaggtttttactaaagtagtacccaaaaaaagagaatagaatgatagttaccaaaggatgggaggtgaggggaatgaagagaagtaggttaatggatacaaacatacagttaggtagaaggaataagttctttttttttttttttttttaagtctcactctgttgcccaggctggagtcaatggtgccatcttggctcactgcaaccttcgcctcccaggttcagcctcccgagtagctgattacgggtgcccgccaccacacccggctaatttttttatttttattggagacaggagtttcgtcatgttggccaggctggtctcgaacaactaacctcaagtgatctgcccacctcagctttccaaagtgctgggattacaggcctgagccaccgcacgcctggctaaatagtacctttttaataaaagattttctcacttcactcccagtactaccaatctcccttatttttaccccatagcatttcattatattttaattactacttaattatttattaccacctcctgctcctctcctactagaatgcaaattccaaaggaacagcagtttttgtctatgtttttcccaccactgctatgtctcccagggcctggaacgatgtctggcacacagtaggtgctagataaatatttgttgttgaatgagtctttttgctttcatttaggaaagtattaaccagcatcagattcatctagttcttgaaccaaactaagcaaggctatctcttcatcttaacaaacagagtatccctaaacacagcctctgcctgttgtttctcagcagccttgcgttctatcctctgactctgatacaatacccttttatctggataggtctggtcctggtcccaagtttaatctgaagactacaatcacaaattcattttctctcaagtaggcagagcaaatattagaagctgttgcttccttgatattaggaaaggcaagatcacagcacattaatggaccctgttttcaaaactggagatgactaggaacatagcacatgttaactgtgctcacattttgggaattttttctgttgctaacttacgtctgtatgtctctttaaaataaaaccaaattgccaccatgagactattaaattattatcctaaagagccttagactattttggttaatttaatatttctagagtaaatttggaagctcaaaatcagagtaaatgaggaagttcaaggatgctcttacaagtgttttggagcctcagggaaaaccgaaatcatttagatgcccgacaggaaatggtgctgagcaagccctttttactgtgaaaacagaagaaccctgtctttttcctaatcctgatagacacaaaagtgtaaggaggcaaactttaaaagcaagtgcctgctgggcacggtggctcacgcctgtaatcccagcactttgggaggctgaggcggcagatcacttgaggtcaggagttcaagaccagcctggccaacatggcgaaaccccatctctaccaaaaatacaaaaattagccgggtgtagtggcatgcgcctgtagtcccagctactcgggaggctgaggcaggaaaatcacaaactcaggaggcagaggctgcagtgagccgagatcccaccactgcactccagcctgggtgacagagcaagactccgtctcaaaagctagggcaaaaaagttgtcttttagcaatagatattcattatttctctttacttttaagaaaacaattttttcaggtattcaaaacagtcttttgcctttaaatggaaaaaaaagtttttaaaaaagggtagtcatctagcacttttcaatatcaggtttttctttacttgctattagaaagtttactttggtgggaaatcggtgtgataaggagtgaaaagactgagacacataaactgaaattcaactttggaaatgaatttttttcactcagtgagacttaaaaaatgaaccacccagctgcactggattttgtgttggaactttgagggtgtttttttttgttttgttttgttttttggagacagcattctcacactgtctcccaggcaggagtgcagtggcgtgatcacagcttactgcagccttgacctcccagactcaagcaattgtctcacctcaacctgaccagtagctgggactgtaggtgtgcaccaccatgcctggctaattttttatttttatttttgtaaagatgaaatctcaccatgttgcccaggctggtctgaaactcctgggctcaagcagtcttctgccttggcctcccaaattgctgggatcacagacaggtgtgagccatgcctggcctccacagtttagatggctgcagtgatggctatgggtgggctactttttctatcctccacaaaggtagtctttcatgaaaattgtgacctactcaccctttttccaaatggctttacaggggcagggtgggggattctcttttaaagaagtacttgagaatctatttcagttgcaaaatagttaacaaaatttgatttgagtagttctgaccttgctgtgctttggactcccatttgacagccctgaaggttcgtcattctaatttactcctgcccaaatggtgattttgacagtttaatccaaagtcttttaaagcaatgtctattcataccactttacaatctttatctaatctttagtgttctgaagatttaatttgctgacatttctaatttatggtctaaattatttgagagttttttgagattgagattaagcagatctcatagcagaatgggtactacaggagaagtcatagtatttcagtttcagtgtcttttggtttctgttggcttcctttcgaatcaaggctttactaagagagattggctcttaggagctcattgcctttttaaagcccaataattatatgtgctactagaggatttacaattttagagatcatctggagggctctgttcaaagctttcatttctggttctgagaactgtttaaatatggaaacttcaaacgctgaagtgcgtattagggacatggaaccactgcctaatctgtcaaattttccctataaagggttccactgttcacatactcttaacgaacaatgtcctaatgtctcctgagaataaatcagtatggctttatactcaggatgaacagcagtttggtaccatttgaggcctcctcagctatcatgtaatacccctgatctattgggtggactgagaaagaatatgggaagagagttcttgtttgaatcctagccttggaagtgaactaaagacgctgtccagtttaaaatggaattagcactggaaggaaagtcaattgacatttcctgtggttcattactctttctgctatgtttttaactctatcagatactgtctaatatcataaataggcctttctgttttgtcagggtctctgagaattcccagataattcattggtcaatagagtttgaaatgctatttaaactttgggtcaccaagcacagtggctcatgcctgtgtaatcccagcactttgggaggtcaaggtgggaggatcgcttggggtccaggagtttgagactagcctgggcaacatagtaagactagtatgtctagtctattccagtatgtagactagtgtctacaaaaataacagagttagccaagcatggtggcacatgcgtgtagtttcagctactcacgaggctgagatgggaggatcacttgagcccaggaggtcaaggctgcagtgagctgtgattatgcctccacactccagcctgggtgacagagcaagaccctgtatcaaaaaagaaattaaaataaataaaataaacttaagatggtagataccttttggcgttgattagaaatgcagaactacatgttaatttaactccagcacctagcagaaacggccgcttctgcttgagtctcagatgatatatatcacatagttggagtaagtaccattaaaaacctgtcactccgagccattcccctaggatctgttgactaggttgtgtggtacttaaaacacatctgaatcatcattcctcagagaactggagatggttgacgtcactgcctggtcctagcttggaccagcctgcatataatcattccaaaagctaaaaggagaagagaaataaaagaaaaaaataattcttcagaaatgtggaaaggtcacaagtgacgttatggaagagcagatgatataatctcaaaggcgagccctgtactatttcacttggttttccttgtggcagtgcctcctttggttacctgtggtgagaggtggggtaagaggcctcatttgccagagttcagactgagttcatgttatacctttttatagtacttttgagtatactggtacaaggttagaatattaatttagcctgttcatctccagctgtcccaccataaagagattgtagctcctgcagcaggctttctatactatggaaagaaactaattgctggttacaggcttaagctgacaggttgttctttccttagcagcctcttaaagtaactttaaacaatcattgttattattaagcatttatagcctgcttttgtgttttcaaagtgccttataatttctgtttgctttcctattgatgtccctaaaaagcaagttaatattgttatggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatgatagtctacttcatattatacccctaatcttgacccagccccatgcctccttcacagtatgtgtccattctttcctcttctattacgggaaatacactagaaaaatgtgagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccatagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtagggaggacagtggaaaaatataaaagaagtattgggacagtggaaaaatataaactggagttggaggttgggtggtacagttttacaaaaatatgttggtcatggaagacctatctgaaaagataatatttggttaaagcaaagactcaaaggagacagggaaagaatcatggatttctggaggaagagcattgtagacagaagaaacagcaaatgcaaaaagccatgaagtaggagtgtacctgctatgtgcaaggaaggaacaacaggctcctgcagctggattagagctagcaaggaggagagtattagcacgacctcagagaggttggaggagttggattataggcaattgcaacttggtttttattctgagtgagatggaaaggtttgagcagagaaatatttatgagctgacctacattttaagatcactctggctgctatgttgagcatatactggggaagctaggtgctgtgaagggaatgtatagggggatgtggctggaagactagtggagaggcagagagactgttaaaggctttgcagaatcccatagtagttaccgagtttggaaagacagcaggaggttgtatttggaggtggggaggggagattaagagtttggttttaccacaatgagatactatctcacaccagttggaatggctattattaaaaaaatttttgaaaataacagatgctggtgaggttgtagagaaaaacacaacacttatacactattgaagagcatgtaaattaattcaacccttgtggaagacagtggtgattcctcaaagacctaaaaatgggccgggcgcggtggctcacgcctgtaatcccagcactttgggaggccgaggcaggtggatcatgaggtcaggagatcgagaccatcctggccaacacggtgaaaccccatctctactaaaaatacaaaaaattagccgggcgtggtggccagcgcctgtagtcccagctaggctgaggcaggagaatggcgtgaacctgggaggcggagcttgcagtgagccgagattgcgccactgcactccagcctgggtgacagagccagactccatctcaaaaaaaaaaaaaaaaaagacctaaaaatggaaataccaactcagcaatcccattactggatatatacccaaaagaatacaagtcattctatcataaagacacatgcacacctatgttcattgcagcactattcacaatagcaaagacatggcatcaacctaaatgcccatcagtgatagactggataaataaaatgtggtacatgtataccgtggaatactatgcacccataaaaaagaatgagatcatgtcctttgcaggagcatagatggagctggaggctattatccttagcaaactaacacaggaacataaaaccaaataccacatgttctgacttgtaagtgggagctaaacgatgagaacacatggacacaaagaggggaatagcacacactggggtctgctagagggtggagggtgggagaagggagaggatcaggaaaaataactaatgggtactaggcttaatagctgggtgataaaataagctgtacagcaaatctgatgacacaagtttacctatgtaacaagcctgcacatgtacccctgaacttgaaataaaagttaaattttttaaaaaagagttcagttttagacatattctttttgagcaacctattatccaagtgaagatattaagtaggcagttggttatatatgtgatcattgatttccctcaagcaatctaggcatgatgttatagcttttggaaaatagtttagaacttgtctggattatatcttcctactatctctacctgttgggatagtgaatttttaaataagaaaacaagaaactgtctttctcttttcctgtctccctccaacaacaatatcatgctctttaaagctgatttagttatatttaagagcaatcagcatcaggattggaattaaactggcttcatactgtgtttttcccttggttcttttttaacacccaaaatatgattggcatatccttggaggacctagcattctttgggttgtgatccactacctgtgttgtcctttcttagcatgtagatattatttaactcagtgatttgaaaccaaaagaacccatacatcatcccatccccccattcctgcctcattgagaatcagtgtgcctaatcagagatgttgctgatgggattctgttatgtatatgaatgatatggaggtagaaaaaatgttgagaaacacagtgtttcatttttatttgttcaacatcttccacttattttcatgcaacaaatattttttgaggtagtcaatatgctagcgaagatgagagacagaccctccactcaaggagctcattgtattataggtgagccggaagtaagccattattatatgctatcatagaattgtatgcgttgggtgctgtggggaggtgttagagctttctgggaagtgttaatcttgaactgaaccttaaggttaaataggtattttccagacagtgctaagcttaaggagaagaaaatattaagcagaaagaacaacatataggctgggtgcggtggctcacgcctgtaattccagccctttgggaggctgaggtgggcagatcacgaggtcaggaattcgagaccagcctgaccaacatggtgaaaccccgtctctactaaaaatacaaaaattaggtggacgtggtggcacacgcctgtaatcccagctactcaggaggctgaggcaggagaatcgcttgaacccggggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcctatgttactgaaatgaacccagttctagcctagagtgaaaatatgagagctgcaaaatacagattttgaaaagctaatgtaaaagagatgaactgcttcccccaatgaatgacctgtgtagttgatcctataaagagatgacaatttaccaaggcagtagcaaaaggaatcattaagctaacaatctgccgataagccttttaaaaagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctctgttgcccaggctggagtgcagtggtgcaatctcagctcactgcagcctctgcctcctgggttcaactgattctcccacttcagcctcctgagtagctgggactacaggtgcatgccaccacgcccagctaatttttgcatttttagtagagatggaattttgccttgttggccaggctggtctcaaactcctcacctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgtagggtagggcctggcatctgttttgaaaagcctttccagatgattctgatacaggtcttcagttaagaaccactaatattatcctctagagaatggggatactactttatagtcaaagataatcacttgcatttcacatgagacctttacatgacccaccattagcctacccccatcaccccagttttcacttttttttttttgaggcagttcactcttgtcacccaggccagagtgcaatggcacaatctcggctcactgcaacctctgcctcccgggttcaagtgattctcctgcctcagcctcccaagtagctgggattacaggtgcccgccaccacacccaactaatatatatatatatttttgtatttttagtagagatggggtttcaccatctggccaggctggtctcgaactcctgacctcaggtgatctgcctgcctcagcttcccaaagtgctgggcttacaggcatgagccaccacacccggccccagttttcacttctaaatgttctttacagagcctagcgctgtctcaagatcttcttggtgcccttatttgaaataagaattctcctctcttacctgccaagtaccagatgagttagaaaatactctttcccggaagcccacggctggcatcaatctttgaaagtagtgctctggtacatcccttgttgttgttgttgttgttgttttgttttttgttgttgagacggagtcttgctctgtcaccaggctggagtgcagtgacacgatttcggctcactgcagccttgcctcccaggttcaagcgattcttctgcctcagcctcctgagtagctgggactccaggcatgtgccaccacacctggctaattttttgtattttagtagagacagggtttcaccatgttggccaggatggtctcggtctcctgacctcgtgatctgcctgccttggcctcccaaagtgctgggattacaggcgtgagccaccgtgcccggcttcccccctttttttttttttttgacagagtcttgctttgtcacccaggctggagtgcggtggcgctatctcagctcactgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctctagtacatcctaaagaatgcctttagttcctctttcctgacattactctgcttaaattccccagattcaagctttttgagaatcctatctcagcattttgggcatcaggccatgttatatataggtcacaaactcctagccttgttagttgacaggttaaaagcaaggagaataattggatggacacttctgggagagagaacgcaaatattatggagaagggaatacaggcaccatttaaagtaaggaaggtaagttgatactaaatgtagaaggactggaagtactttagaaagaggatatttggatctcatagccacagttttaagaggtcagtatgctgttgaagtgtagacatttgccataaaagacagagagtgagaatagtgtactagataagcactttttaactctgtttttagagcaaaatgagaaagaaacaggtatagttactgatcatagaacttgctcagataaatgttttcctacagcgctaagagcatagataggaaagtcattagtgacagaaaccagtgggaggtggtgacttagagcaagtctcctcctactccctcttcttacagtataagggccttatgatgtgctgctgtgcaatctgcctgttcctgaatgtatataccaatcagtgttgccctgaataaaagtacttactgtagctttaaaaaaaaaaaacaaacaaacaggatgctctgaattaagcaggctatggtagaatcatagtcgagaagtttgtattgtgagaagaaaatttatttatttgctcgcttaaaggttttttgttcttatagtcatcaggtttaccagtgttgggccaaacaagctttttccaaccataagacctgggaaataaggttttataaaagaaacaactttaaaactgatatttaaaaaaataaaaaataagagatagtatggcactagttattgtggggagaaataaaaatcaaggtttagcgtcaagtttctgtttgaatcgtaattcttctgtgtactagctacatgactctggatgttacttagtctttctaaacctgagtttcattatctgcgaaatgagaggggaatgatatctactttgtttgagatcattatagtgtgagttagaaataatatcattaataggtaacttagtaagtggtagcagctactattaataatcatagagaaaaaaatcacagactagattattcctggtatacaagttgtgccttgaagacaggccttctggaaggaggtagagttgcaggttgtcacagttctatgacaatggagtaagtaagggtgtgctttgcagtatatgggccagtttgtttgatttggggagacctgcactgagagaaagaggaaggaaatagggaggcctatttctagacacagcgctgttcttttcctcctacctggctccctgcgatgtcctcatttgaccttgttgctttcctggcaggtggctgtgaaaaacaatatcgatgtcttctacttcagctgcctcatcccactcaatgtgctttttgtagaagatggcaaaatgggtaagtaccttcctgcctgtcctgctgaatatacctttgcccttcctgtgcatgtcaggcagagcatagccccagaagttttgagttattttgaggttaaaaaaaaatgggttaaggatattctaaagctcttaataattgctcattatttattctcctgtgtcacaattgttcttgctctgccattggtctctaaatcacagtgcccaatatctgaataatccagtcaccccaggatacagaataagaggtttggggaccaggtaaatatggatttgaatctcagctctgctatttatttgctgtgtgactggtcaaggtgataaactttttggaacttccgcttccaaatttgcagtgtagataatttttataattatttcatgagataatacatgtaaatttagcactttactctgtactaagttcatactgcctcaagctaagaattcagtaatttgtaataaaccgtcagaactcccgatgtgcctattgacatttctctcttcccttatttatgaatcacaatctaataaaactggcttatattggtgcatattaaactatgttggcacttaattgatttgattcttacaatagctcttggagtaggcaggacagatgtaattatagataaagaaattaaggctcagaaaggtcataagtcaccaaaataggaaaacaagggagccaaaatgaaaccctagatatagactcttttccaattatcctagtgttactgatgacggattaattgatctgaagtatagcacttttgtagagctcagcattggctccattcccagcctgctgctagctgtattgcaagagccagcatgccaaaggaaaaatgatgcaaggcatcgaaaatcagaatactgacagcttatgcacatccatccttcccctctgctttcccatacagagcgccaggtcttccttgcaacatggaaggatattcccaatgaaaatgaacttcagtttcagattaaggaatgtcatttaaatgctggtgagtaatatactctaaatttcagtttcatcttagtaaatcaaattagatatttgaaattttaatctttcttttgcctacccttttatcctcccccgtatctactatgtttctagtgggtatatatggtagatgcattactttgcaaacctctgtttaaaaacgtgatatgttttgatgtaggtactagattacttacaagctaacatttaagaaacaagctagaatcgacccatctacccatttcttcactaaagatgtgttagttctgttacttaaacatcctaataatcaaaaactgaagtggcacttgagaacatgcactcccttagtaattgaaaggaccattttcttcttttatatcaatttttggtgttggaggaaggttaactttctttcttagattctgtacttagaaccctgtgtttataatgaaataatgtatcatcattagtgaaagcctcgttgggccaagtatggtggctcataccagtaatcccagcactttggaaggccaagatggcaggatctcttgagtccagttcaagaccagcctggacaacatagtgagaccccatctctataaaagaaaaaaaagcctagttggtaaccttttactacactgccctgtgccacctttcatatgatgatactaacctctttaatcaccattaaagagctccgtactctttcatagttaactttgttactgtaaaagaacatgaaaggggtatcccaagaagagaaacaatagcagctattagtcccttgggctgtgtttctctgaaggatttctcaggaatgaaaggagccctaagttatttagagtcctgcctttgtttcactgttgctctctctttctctttagagctctttctttctctccttttgaagttagtactaggctttgtgagtttgaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacacggcagcacagaaagcaaaaaaaaaaaaaaacacacacacacacaaaataatgccttctcattccagcttcccccaccccgctccccggcccaagatggagtctcgctccattgcccaggctggagtgcagtggcacaatctcggctcactgcaagctccgcctcccgggttcatgccattctcctgcctcagcctccagagtagctgggactacaggcgccagccaccacacccggctaatttttttgtatttttttaatagagacggggtttcaccctgttagccaggatgttcttgatctcctgaccttgtgatccgcccgcctcggcctcccaaagtgctgggattacaggcatgagccactgcacccagcccagctttttaattttagttttttatggctctatgtaatattcatcttctgtgttcagatgaatcttatagggcttttgaaatccaacatcatagtgatcagctttatcctgtgatacctcttttaaatgtgatgctcctataggccctctctgagacattcaggagactgaagccctcctggaaccctcagaataaaagacattcagacaggcatctttgcatatagaaacttcaggcagatgtttgcctctgataattgtttcacgtctctggagctcttggagaggtgtttgaagcatggtcttctgtaatttccatcataataattaattgtttcaattaattcagtaataattgatttttttcattttgtgtcatatttgaagaagatgacagtgtcatctttccctcactttgaggctcactggtggatcctattagaggagccacctctgtacccagctaggaagagaccaggcccctggttatattcacctttgtgggagttggttcaatggcaacatttcaaatagaatgttcctcagaacacttttcccttatgaaaaagggttttgggccgggcacagtggctcatgcctgtaatcccagcactttgggaggccgaggtgggcagatcacgaggtcaggagatcgagaccatcctggctaacatggtgaaaccctgtctctactaaaaatacaaaaaattagccaggcgtggtggcgggcacctgtggtctcagctactcgggaggctgaggcaggagaatcagcttggatccaggaggcggagcttgcagtgagccaagatcgcaccactgcactccagcctgggtgacagagcgagactccgtctcaaaaaaaaaataaaaataaaaataaaacaaagaaaaaaagcgttttgttatccatgaaagttgaaaaatacagcatatgctaggcttcacctggaaattgccattgcacgttagcagactaaaagttctgagaagtgctatactgaagaaacctatttaactcagtgttaactgaacttatttggccttggaatttaaaatcacaaaatacttattagtaacatcatgtggaccaccagtattccttgaacatgatctggaaaacactctccgagagagaacagagatagaccagagtgattggaaagcaggttttgtttcagacatgttcagtatgaaagggacatggttgttcaaaaaagaaaatagaagttggggtgactgaggactttggtctgtcaaaataacagagaagaaaaaatcctcctgcttttagactggagttttgaactcttattgcacctcggcatgtttttgtgatcttatcaaagaggaagtgtctggcatttctcctagtggggctgtgccctttgatgtcgtttctcagagcaaattcagttttgatcaattctgtcatggcctcacgccaatcgctccatgctgtaggtgctccaaataccaatgaatcagattccagtgatacactgctctgtggccatgccgcacatgaaacataggggaaaacagtcattgcattttctccaggagtccaaggccaacattttcccacattaaatcactgctagtcttgcaagaccacttcctgcaactaatcctttccagctcttcctttgagtccacccccaggtctggagtgccctggcctttagatttccttccagtctcgagggctctattaacatgaacgtttttggctttagtgccttctgattcaacaccctgggtctagctgagagctaaaaataccatcctttccagctgatctgccctaatcacaatagcaccaacactttaaatagcttttctgtgctagcatagacatttgacagatggaactaacactctgagggctacaggaagtcacaggcttaaaggacttaaccaacttagcactgagctttactttgctctttcatgtctttctagagaataaagaaagagaccctcttcccaagtcttaataattaatcagatcttaagagaaaagtgtatggtgggagtgcttatgatgccgctaattgtgttaagtactagaaaatgttagatcagaaagctgctaacagaagtctctcctttctagcaccgatcatttctgtggatgttgggagatctgtatgaatctgttttacatcttaccattacagctgcatttggggttaataggtatctgggactactgtcttaagtgcacaagaagtagttgcatctccagccatatctggaaaggaatctttgtgacgaacagttctacaaaccagttttttaaattaagtgtttataatattaagaaaagctcagagacttaatgtatctattttcattagttaggtactgtaatgagagacaaatatttgttccagcatgggggctaggtaagggtgaattctgtttcattgttttgttgcggctctccccatcctttggaatatttcaaaaatggaaacactcttccagctagcacctaactatcatttggttgcttaaatggtaaaaagcattcttttcagcagtcatagtggttttgaacttgctaataaataccacagcagggccccagatgtaaattcccccattcccactctctaatatgagtacctgcttcacccttgttgctgtcagaggatgtgtgaccttagctaaagtagaaagataaaagaaggaagatcacatcgacaccttctaagagttgaggccccagattcaaaatgccaaatttatggaaggatacaaatgaaccataagaaatcttatattggctgggctcagtggctcacacctgtaatcccacactttgggagcctgaggcaggaggataatgtgagcctgggaggtcgagactgcagtgagccatgatcacgccactgcactccagtctgggcaacaaagaaagactctgtcgagagagagagagaaagcaaggaaggaaaaagaaaagaaatcatatcttgaacgaagggtaactatatttgaccatctttttttattctatgctttgggataaatctcagtgtcttatgcctcagatgatatcatcagcacacagtgaaacaatattacattacattctcattatcaaactctcacaactataagattccgtcctgtttcccagaaggtcaaaatgtgttttaaaaaattaaaaactatgatatcttgtcaagaattctatcccagtcagaccaggaagcctccttatatctggcttcccttgccattcatcatacatttagcagaatctcatcattctgcaatccgtaaatcttcaaactcaaacctaataactaaaatgtataaaaatcgaatcacacatactaatgttatggaaccctctctctagtcttctgataaaaatcacagtacagtcattcattaggaacagagtcaggttgctggccagaatgcttccaaatgtattaaagttacatccattcaacttgcttattcttcctggctgtttggcatgttttctaattctagaagagtgagaataagagagagagaggcagagagagtttcttagcctgtcatctcttacataggtggtgaaataattgagaatatttcatgattatttctgtaggaatctggcccttgccacatgtatatgctagaatgtatttgtgcctatgcaacaaggtgggtgttcaacaaaggctcctactttgtgtgtttttgggtttcctgggaaatgggcaagggcctagaaagttaggaatgatttttacaacttaaagcaagcccctctgtgttcaagacaatcctgtcaaaaggcattagccaaaccctagctgatgatgttgcctagcaacccactcaaagctgcaagagcccttcattgtgggaagcagggtggcaaccagaactgcctcatcccccacaaggtgattaaaagggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatccccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaacacacatggctcataaggatgtgagaagagagtgtacatttgtttgagattttaactgaaggtgttggattttgaatctgtatttctagacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacggtaaggcctttctcagaatgggtgagatggattagaggagggaggtgagagccctttcatgtttacttagcaccctagaaagacctggaggaggtgctttaaacctgagatatacaaaataagtagtcaatgaagaagcttccatttgcctcaatggaagacctcctctctgcagtgtctgccccatccaacaggaatggtatctctggcaagtgcctcaaatccatccctcccccctggtgtatacagagttgctcacaaaacttggcagcttcatcctcaatatcagttaatacatatctagtgtatctgtgcatgtggtactataataagctgccgagaggattgtttacatagttaatgtccagaagacctttcttgctgttggagttcatgacctaaggctatcagagtcattaacacatgagcttttttcagcagcattgtatgacctgaaatgcttgttattaaaggtgaggcaaaatggaacacacctttggaagcgtataaggggactttagtttgggaaatttccttcagtatcacactgaactaaagtaaaacttctggcaataataaggcagaagcagttgctttgttaaacagcagattgatagccaagcactaggcatttgtttgctgttgtaaaatgcaatttcccaataggatgtcatctgcattttgaaaagtaaaggaaaaacccttgggatgggagaaatatcttattcctctgttatgtttgagggttttatggggatctatttatttctgaggaagctgaatagtcagtagcttaagggagccttttagtcatttagctgagaaaactctgtgacccgttccttaattttgacagctaagtctgttttcactagcatatatcaagggaatagtaccatccagaactgaaaattcttggtgtttttcccactagttcccatccttgtagtaagttggagtagctgtgtgtgtgtgtgtgtgtgtgtgtgtgtgtgtgtgtgtgtgtgtgctcgctcctgaggcctatcaagttagacttttgcccaagcacttatgagctgaaaaacttcaggcttccctcataaaatgtatgctcctctccccaaccccccaccagtctcatctcttttggagagtaacatacactgtcatttatcttgagtttcccaagaaaggaaaacccctctgtgctgtttctggagggacaagttttactataaaaccaagatagcacatgcctgtaatcccagctactggagaggctgaggcaggaggatcacttgagcccatgagttcaagaccagcctgggtaacatagtgagaccttgtctcaattggaagaaaaaaagggttggggggagaataactccatttactctctagaaatttgccaaaagtttatatatgggtgtgtgtggttttttttttttcctttttttctttttgcttactgtccattattttattgtatatagtcttccatctcagctaggttaaaggagcatgattactcccaggttgcagataagtaaaccatggctaagaatgattagtgactagttcaagatcatgtaatttgttggtaggtgaattttgtttagaattcaggtgtttcttgacactcttcttacacaatattcttgattttgagaagagcttcttagtatcactgtcctaaacatagtttgttaaaattttaaaaagtattttattttgaaataaagacttaacaaattttttaaatggaacagtagagtttctacatctcttttacccagttttccccattaataataacatcttacacacccatactacattttcaaaactaagaaataggtattagtacaatataataaactaaactatagacattattctaatttcaccagtttttacattacttttgggggtgggggattggtagtggatagtactatgaactcttattacatgtatcaatttgataactgctgccagagtccagacacagacttgttctgtcaccacaaaaaaaaaaaacttcctcttgctgtccctttatggtcagactctcaccccagccctaaccccggcagcctttctccattactataattgtgtcatttttagaatgttgtataaattacacatgtaacatgtaacctcttaagattgttttttgcacacataatactcataacattcttccaagttgttacatgtatccatagcttgttcttttttatggccaagtaatagttcactgtgtccatgtaccacagtttctccattcatcctttgaagaatattttctcctttatatttaaacaaaagtttggaagtaattgtaaattcatatgtagttgtgagaaattatacagtgacctggtgtggtggctcatgcctgtaatgccaacactttggaaggctgtaatgggaggatcgcttgaggacaggagttcaagaccagcctggtcaacatagtgggaccccatctttattaaaacatattttttttaaagaaatacagtgagctcttcctgtaagtgacctgagatgatctctgctcagttggcctagaaaacccccaaaatcatacaaagcaagagattcaaatcttcatgtttactttaagaacacccgtggaagtgcccaggccatcaaaggtatgcatatccaaatagccaccaagtacttgaaagatgtcactttatagaagcaatgtgtgtcattccatattattatagtggagttggtatgtgtacctaagccaaacagacgggctgggcacaggatgacaggtggcccaaaaagagtgctaaatttgtgctgtacatgcttaaaaaggcaaagagtaatgccgaccctaagggtttagatgcagattctctggtcattgagcatgtccaggtgaacaaagccccaggatatgttgctgtatttatagagctcaggtcacattaacccatacataaactcccctgccacatattgaaatgatccttactgaaaaagagtaaattgttcctaaaccagaagagagggttgcagggaagaaaaagatatcccagaagaaattgaagaaaacaaaaatttataacctgggaataaattcagcatggaataaatgcaaataaaagttaaaaaaaatagattctgtcctcgtggtttagccacatccaccttcctttgtcccatatatttttattttatttatatatatatatatatatatatatatatttttttttttttttttttttttttttaatatagagatagggtctcactatgttgtgcaggctatctcaaactcctggccttgagcgatcctcccatctcggcctcccaaagtggtgggattgcaggcgtgagccactgcacctggcccacccgccccctgccccatatttttaaatggtgaatttgtttatacttccttgccctctttcctattcttcatcctgtctggtgactaggttctctgcccacaataccatctaaatctcccatcatagcacttgacaaataggtctaatttgttcccctaagtggcacccttttagtcattagactaaaagaagaggtggtggtagaggggtatcagaggtatctgatttgcctatctaaagaggcagactctaaagtcattctgatccattcccttcatcaccttaagttcctattatactattaatctgatctgagctaagtattaagaaagaaatcgggttgagccagcactaatgcatgacagactgatggtcccttagtctcctaagaggggttaataaaacacttctccccaaaccccagtttttattgtattttattaagaagataggtttatcctataagggtgaggctatatctctgtaagtaggtaatcctcacctgaaagataacttgtcccacgtgaagcagtgtatgttccacaccatatgccaaaagtggatgcatagccccttaattttaattaggcaggacagggtgactcttctgcccttggtgtgtctagtttggactggattcctgaatggctgatgttaaagacatgtcacataaggaattagcagttggaaagttaagccccaaggaaggcctctttctccctaggagccatacaaaatgagagccagagtcctagctatatgtaataaacttgacactttgtcagaggctggggtggaggtaggggtggggaggtgtggatattaagagtccagacacagggaaagtttcttccccatcctccaaagaccagcggtaatgcccagggcctagggtctggtcagtccatgacttcccaccaatgccagccttggcagtttgagccattgttgaggaaggcaacatttccttactagttgtaaacataaaaatgaacctccagctggaggaacttcaagtattgttacaaagatgtggaaaaatacaagatagtattttgggggagtatttggggactacctctccttagtctgggagttaactctcttaagctgttgtttctctttttagattcctcttctcttccatttctgaatccacatattctcccactagaattttccacaacactggcagtagagaaggctgtagagaaggaggtacaagaattgctttaggtccagcgcagtggctcatgcctgtaatcccagcattttgggaggccgaggtgggtggatcacctgaggtcaagagttcgagaccagcctggccaacatggcaaaaccccttctctactaaaaagacaaaaaaaaatagctgggtatggtggcacgcatctgtaatcctagctactcgcgaggctcaggcaggagaattgcttgaacctgggaggtggaggttgcagtgtactgagatcacgccactgcactccagcctgggtgacagagcaagactctgtctcaaaaaaagaattgcttcaatagggagtttgaaagtcagggaaatgcctaaagatgcaacttggaccaaaatagggagctgttttctatatataaggaatagctatattcttaagttagttgttttggttttttttacatttatcagaattgtcttcctgactaataccaagcagcagttttgggaatgccttggggactgaatattaaagctgtaaatcaatagaatatcttcccatgttcttttgtttggtttggggtttttttgcattttaaattttactttaactttttaggttgttagtttttaggaaattcaccgttgaccaaaatcttcttgaccttttattcaaagatagtctcacttttgcactatgttaaattgtccttagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcaccattaagatctttttaatattgatgtttaatttggtattcattagactaaaagaagaggtggtggtagaggggtatcagaggtatctgatttgcctgtctaaagaggcagaaaataaaagattaagctgttgatgtgaattgaggttgggttatactaagtaagtgtcttttcatgttcttgtcttccctcttaggggtgtatactctcctcattataatacagaaaggactaataccttggacctacctagtttatggttttatttcacttgattgtacatcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaagtttgtggtatgtatttttttccccagaactgacattctaggagaaaacacagcaggccagagagggacagaacattcataaccactctattaaaacttttctgactgccccagccctcccagggattcagccacatgaaattaagagtgacttgaggaagaatcatatacctcctgggggctccttttgaccaagacccaaagcaccactgcaactccaggcatctttgcaggcagggagtgctcagaggagtcaatctgtcttttcctggcagttcccctgctggggccccaggcaaatggtcccaggggcagtagccggagccacagggcctttttctgacttgtcagttggcatccagccagcagggcccagggcgagaggaatgcagcagagcttctcatcggtttattacccaggatgtctcaatcatctctcaacttacaaaagtctctcaaacccggcctcagggcctgcatattcccaagcaaatggaattaatcctgctttaaaacaagcttcccagggagttccaagactagaggcctgcatttgtgttgttgggggcatatgacccatatgttgtcaagacaggaggccccccgccaagcctaggttctgataagctgacagctgctgagatctcccactgcctggaatggggggaagaggctggaatgagggatctaacaccaagatgcccctggataagtccctgaacctctctcaccactagagtgaatgtagataaagcactctgtagcatttgagacttagtaggtgctcagcaaccgtagctgcctttattacttggatgtccaaaccccatgagcaaactgccttttggcagctaggaactttctggttgtctccatgttgccaggctgcagttagctgtaataggaaaaacacttggtgagaggggtcaaaccggggttgccagttaagaatgacgttaatttgggcaaagaaagtcctgaaggagaggttctcaactcttcggtgcacattaatgtcacctggagagctttcaaaaaagacatggttcagttcaatcagtctgggatggtacctgggggaatcagcatgttttaaaactcccaggtgttttctaacgtgcagtcaaggtcaagaatcactgccagagagagaggctcacacctgttcacctacttcctcttccacagtaatactcatgttctgtggcagttgaaaaatggttaaagcacttccatatgtacaatacctgcctattcccttacctatctcatgaatttaatttcatctccagtttacagatgagatgtggcagagccacgtcttctgactccctgtctgtgtccttagaactacactgtagcttcctccttcgtccactggaggttctgtaataggttctctcctacctctgctctcagccacatcccagcttgctaagcccctaggataccagtatgttcagagcacaccggtcccagacttgcacctgagactacactgtctttctctgcctgtaaagtgacaactaggaaacactgagatgtcaggtacattgtttctgaggtcagaaaacagctaaggactcgcaggtttgggctttctactcccacttcgtgcattaatgctttttctggttttgcttagacccagattctttttccctgccacccccagctccaggaggcaagagcctgtttattttaatacctggtatggcacttggaaaagatcacacctcccccgttgttacccaattctatctcctgaacactaatcctagaatcccaaccagcccccagacatgttattagcaacaagggatgtttcttgaaaagtttccgagttggctccaaacttaccatctcaatttctcatttagcttttgccctgccatgcttgatgctgccaacaaagggaaggctaatttgggggttggttacacccaggttctcagctggaaaagtgcttgcaatggctgtttccaagagcatcgttttga

SEQ ID NO: 14514 - DNA, 152393 bp, Human
  misc_feature (1)...(152393): n = A,T,C or G
gaggcccggccagcctgcggtgggtgggtgacatgtggcccggatctgcccggggcgcctgcctgtaagtgggcccagcagacaccccatggagccgaggcaagccgtcccagctgaaccggcttaagctgcaggcccacagagtcatgagcagtgaagagaggttttcgccctctgaggtttggggtggcctgttacacagaaatacacacaacgtcctcaggcacgtatctctttaagaatgtgtcccgagaaggcgtcccaggagtcttgatttttatttagccgtccacggttgcccctttgggtgcttcgccttcagatggggtgaagggctcacttgttagctggctggccccaaagacaggcttgttttccaccaggcagtgactgaagccggcagcctgctgcataccgcgggccttcccctgacctgtccgggactgcgggctggcggctgacacctgcggagtgcttaccgcataccaggctcccaaacttccatctgtgttcgtcttttaagttttgttgttttccagagtcggagtctcagtgttgcccgggccagagcgcagcggccatttataggcgcggacctcggcctcgcacaccacagctccagctctgagacacaagcgacccgcacccccccaccgcccagccccagcctccagactggctgagatcacagtgtgcgccaccccatccctggcttgcgatggtctcttactccccactttacaagggaggaaagaggccgagggcagagtgggccgcctgaggtttggaggccagggctagtacaacctcaatttgaccctggaacctgccgcttcccccacccaggtgcgggacccacccgcttgtccacacctggctctgcccaccgcccccggctgctcctctgggctcaggtcgccgcggtcaggagctgccaagtttgcctatcaaactttatcttcgtgcagagaactgcagcctggagctggttattccggtcagtgaaaacgttgcatttctacatatgcttatcatcatctgtgtaaacatttcttggtataactgtggaacagtcagtaaatatagataaatcgaagagtaggtctattgcatatgctataaaaaaatgcttttactatcaacctaaaacaaacaaacaaacaaaaaaaatcaaacaaaaccaccatcacctaaacgttggtaactggagcagctgctagtgtcagtgcggactaaacaggagacggcgggaaccgtgtccagccagggtcctgggccgcgacctggttctcccggagtctacagtgaggatgacgggcggggagagggggccggcgggacccgcgtgtcccaggcaactccgggagagggagaagcaggggtggctcggcgggggctcggcgggggctcggcgggggctcggcgggggctcggcgggggctcggcgggggctcggcgggggcagcgcccgctgcagggaggagcgcgggggcccgggagcctgggcagcaccgcgagacgccacctccgcaaaacgcaaacgccaatcgccgggcgcctgcggtcccagctaccagggaggctgaggcggcaggatcgcgtgagctcggaggtccaccgcgctccagtctgggcgacagtgagaccccgtccccaaaacgaaggcgggcagagtctcctcagccgcgctcgggcgggcggcgccgcgacgccaggccggtcccgcgctctcgccccacgctccggagccgcccagccgcggtctctcagctccggccgcgctccagccccaacggccccgcgcccgtccgccgcaggtggtcgtgagggaggtgccacagctccggctgcccacgacagacacgggcgccccagcgcgcgcacgtccggcgtcgctgcgccgcccccgccccctcggcgtgcgcgcgcccggcgggccggcgggggcggggagggggcggagccgccggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgaggtgagggcggcgcggggccgcggcggctcgggcgggcgcgggctccggaccccgcggtggcggcgtttatgtaagcgccgggcagggactggtggtggggccggagctgcgggccgtcccgggagcggagggcgcccgcggagaagcgagggtgccgcggcaccgcctcgcacccaccctcctgggtcgcccgtctgctccggcgctcggctcccggaggaagctgcgcccgggcggccccgcgtcccctcccgagggcgccgagtccgcgtgggatgcgccgcgctgcgccgcggggagggcaggtgcgccgggacgaggctgcgccctggggaccgagactgcgttttggggaggggacggtgtgccctggagatcggaggctgcgctggggacgaggctgcgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcggcccgggccagggaagttcctgcgggtgccgggcgtctgcagcgatcgggagcaatctggggcagttgggggcccgaggtgacttttgacgtgttcacatcagaaggaaaattattgcgtggtggatgggtgcgagggaaggtgtcagattgggctgtggacgctgaaacgtgttggagtcccgatttacacgctggaaaacctaacctaaaacgtgttcctgtccaggtttctatgtcggagatctgcaccgtggtgtttagttcccagttaatatttttggtcagcaggtttgggctgttacttctgatacaggcattttacttccttcttactaaccattattgcattccgttctcgaagtataacgaaaagtggcatgatatcaaacttgtttctttaacgtttaactccataattaagatgatagaaccgtagtttttttaattgagaatacaaatatgtatttaatcctctttgtttcctcttaaattttgccgtatgttttattgcttcgaaaggtgccacccagagctgcattttccaaaacgctaggttgtcttaagagcagttgtttctaggagatagaaaagctaattgtcttttgatgaccatcttttccttggggttgagactgctgtatcctttttgcctgctgagggtttcccagaggggaaagggagaaggaagaaaggataaaagcttggctgatacagttccttcttggataagagaattaactgtctctcattgcgcggttcctccggaggacagggtccagtatgcatggacagccacaacgggggctcggtaagtatttgatgagacaggctgagctgggtgcctatatcttgcctgtggtggagaggatgaactcacacagactctgaaaggaatgcattgtctgtgagtgatgccctgttagatgtctgagggttcctaagactgggtatatcccactacatctacatcacatttgaagctgtagttggaaaggaaaaaaggaggccctcctgcagggacaggggcttaaaaataatcgatccagctctgagaaattgatgacacatgtgtctctggtgtgacgtgctcatgcagttgttactgggaggccaagggggaaggattagctatgaagtgataacatcatccacaaaaaacatcttggctcagaggctaatttcacttcctcgtgaatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctgggcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaaaagtttagcaaagttatcaagcttagtttgaaaccaaaaagctcagagaggtccaattttattagaaaactcaatggtggccgggcgcggtggctcacgcctgtaatcccagcactttgggaggccgaggcgggtagatcacgaggtcaggagatcgagaccatccttgctaacacggtgaaaacccgtctctactaaaaaaatataaaaaatcagccgggcatggtggtgggcgcctgtagtcccagctacttgggaggctgaggcaggaaaatggcgtgaacccaggaggcggagcttgcaatgagctgagaccgtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagttgacagctttttatctggggtgtggacagggacagcgcagtagcccacagaggtcttcgtggcagggcttaccgcaccttccatttgcagagttttgcttcatccatagcttgacagctgttgggctagggccattaatatcaaattatcacaattttttttttttggtagtttgattagtactgcttgctgcacttttccacctgtatgcctataagatgtcctaggcgtacacaaagaaaagtgactttggttttaggtttaacgtctttgtgatggaacaggaagggggatgaaagtaactctgagataccttgtatttttattggaagtacagtgaaatggaagctctacttgcttctagtttggtgattttggaacctggttccatttcatttgcttgttcatccaacaggcattcacccatgcatcctggcccaggtactgttctaggtattggagattcaggatgagcctgatgaggagagttcctgccctcaagcggttcattttcttgggaaggaggagagcagtaaacaagcatttggtgtcctaactgcttcaaagggcaaatgaggcagggtaggtgagagaaggtcaaataggtggtgaggatggagtgagctgggctgaggtcacggcagcagcagcctctcaggcacagggaactctcgggtgaaagtccctgagcctccttgtagtatggtggtcacctcagggaggccattgctgccagagaggctgggcgagtggtaggaagtgagatgggagtggaggagagctgcatcttggagcacacaggctgtggtaaggaatttagattttaagtttgatgggaagccttaagggagcctttcttccttccttgcgaatgacatgatctgatttatctttaaaaagtaccactctggctgttgggcttacaatatgccaggctgttttaagagctttacatatattaattcatttattcttatgacagtccaaaaagtaggcattattatcattattcccatgttacaggggggaatacctaggcacagagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagcggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggaggggacatgggtacaggaagtttttagttgtatttttaaatgagagcgatgatagcatgttatgagctaataggaatgatccagtagagggaaacatttataatatgccaggaaagaggataatgttggagccaagtccttgagaaggtgagagggaggcaggaagagcagggatgctcagctctagaagggaggcgggacttcaggagggaggcaggacttctgcacgtgggagcctggactcagaaatattcctcaagacatgctgcccttttgaaaggaggataggaaataaatcatggttttgtcctcagtcctaaaaagttcggaatctcaccctaggactcaggatccagcttcttaccagcttgtgctgaacatgccatggggcgtacttacggaaagatacatgtggaaatggaattttttatttatttaaaaaattcacttttctctaaaagtattgttacctggaggttggcacctttattcaccaaattcagtactcagaggactagaagactcggtgcctgatttgtgcttgatttgcctagctgggaatttcagttttgcatttaagacgactccctcaccaaccctacccccagaggaaagcaggtattgttgctttgggcctgttgcatgtatatgtttatgttccactgggtcagcagcattcagtgaaacacagttgcctgttaacttggtaaaatatcttaattgcatgagttttgatttgtttttgtgattatttgattttttcaggtttggagtttcagaacacccatcttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacagggaggaggtctgtgcttctttgaactgacattctggtggagaaactaaacagatcacagaggcagacaccgtgcctcacaactacacacggacccggcttatgatggttccagtaacaatttttgacttgactgtggtacccatacagtcattctgtttttcacttttggcatagcattcaataaattgcatgcgatattaagtactttgttataaaataggctttgtattagatgattttgttcaattgtaggctaatgtgagtgttctgagcaccttttaggtaggctaggctaagctttgatgtttggtagggtaggtgtattgaatgctttttcaggttaggatgtcttcaacttgcgatgggttcataggatcggaactccaccgtcagtcaaggagcacctgtgctgtctttatcggcatgaccgaggagacagggctgaggtagatggcatcaagagggtggctcctggtggaggtatgatgttctgggaaggcctctctgagtgcgatgtggtacgctgaggcccagagggaaagcatgagctcatgtcaggaggggggacaacagccttctggctagaaggatagcctgccagagagcctgcttattagagtggccaggataggaccagaaccattgtccagtcaggggctaggaggtgaggctgcagagacacaggggccaggtcctgcagactctcaagagtgcaacaggaagaatggaggcctgggttggcactgttgccatgatttagcggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccctatttatcagatcagaaaactgatgctaaggggctcagtgacttcctaggaaagctggataatgtttaacatttattaagctcttaccatgtgtcagacatggtaaagtgagtttaatctagtttaatcctcatgatgatcttaggatgttgctattaagggtcactgtcatcatccctttttactgataacactggcctggcttacctgagtagcctcctaacagatctcttcttccacttctggtctccttcagtctgttcttgaccagcagtcggatctgagcctgtacatggaagacatcacgtcattctcctgctcagagtccccctgcggccttctttcctgctgtcccttcctgccactcagagccctggctccagctgtcttggggcctatagctagccctcacttcagtgttcatgcaccattgtgtgctgcgtgccctgctcactgttctgtttatttctgccatctgtacccaccactaccttcctccccacacagcctgcctggccagaatgaaagcctcaggaaggcagggctattgctctgaatctgtcctgagggctcggagcaatgcctggtagatagacacttgtaagcctttgctgaaggagagaataactttaacttactttttctgttggtagtaagtagtagaacctgcattaagtttatctgcttctgaaaacgtatgcttttgctgcctccctacactgcccccccatcctattgtacttggtgaatcagtcatatatttatgccccatatgtctgtgttatctccagatttccacacttttctatgtagaatagaaacatttataaaacattcaaaattgttataaaaccataaagtttgacatagtaaattatctgttgaaaacagggaggccacatcctggaaaagtagctctgtcctgccagcatcattttaaccccttttggacaagatacagttgaaatgcattctctgaaataatacttataactacatcttgacagaaacaagaatatttcgaataattctgggaggattcaggaaaaggcagccaaataaaatgaaaaaatacatttgattcaactgtggaggcttaaaggaattacacatcttttttgtttttttgcgacagcgtcttgctttgttgctcaggctagagtacagtggtacaatcatagctcactgtagccacaacctcctgggttcaagcgatcctcccgcctcagtctcagcctcccaggtagctggggctacaggtggatgccaccacacccggctaatttttgtattttttgtagagacggggttttaccgtgttgcccaggctggtctcgagctcctggactcaagggatccaattgcctcggcctcccaaaatgctgggattacaggcggagccattgcacctggccaaaaaagcatctcttataagctgtttttggtgaaggagcaaacaggaaagtgtcccagaatttgggagatcaggattgtaatcccagccctgcttctgaacaggatggtgcattctcttcatgcctctgctgcaggctccttggatgtagaatgagggcagttgaattgcttgttgccgaggttctctccatttctggaagactattgtaagtcagagtcaaataatcattcattcagttgtccaataaatactcatcatagaacctatgtgtagtcctgtctaatggtaggtggtgctacgtcacttcctgccatggctgccgaggctcacgcgaggctggcacttggcagagagtcctgtcccttcttttgactcagtaactgtggaaagaggtgaggtataggaagggagggcctaggccttaggggttaagcgggcttaggaggcaggattgagagaggtggaatgatggattcagagtccaagagaaaacgtgaaactccaggggattagaattgatccctttctctgtttcctcagtcttagggggactagactgtgttagttgtcttgaattaaattgagcaggggttgtttttcacttctgtaagtccagagtttatcataagccaccagaggtaattcagtagtagttaatatttcattaaccctcacttctaaaattacaaagttagaagtggaggtctttaacatatatatcagtcaggctggagagtaagttggaaagttgcattttattcctgtgtgtttacttatggcagtgcacataagcccagttttgtttctttttctttgattagtaacagttgggcacaaggtgtccaacccacccagtgttaagtcacttagagtgagttgatttccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctatcatttgaggtgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagcaatgattggactctttacgtctactccattctcgatatgaatgaaagtagtcacatcaaatgcatatttattagtcttggtcattttgaatttgagtcctttacatactatgtatgtatgtacccaggagcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagaatggaaaaggcaggctttgatttgccagacactgcttgctatgtgtgaagccgggatagggcggtgctgttggacagaagacctgccctgtgtgccttttcacactgcattgagaatttgtctagatgatttcctgggcttattgattgttgaaggaaacaatgcaaattgcaagttatgatcaaataatgctttgagtcttcacctttttagaatgctctgggaaaatacggggagaaaataaaccataggaaaggcattttgaggcggttttgttttgttttaaacagctgccatgaaatgcaccctctctaagaggacaattcagtgattttctgaatgtctgagttgtgcagacatcaccactgtctagttcttgaacactcctgtcacctcaaatgttccctgtgcttgtctgcagttgattcgcgcacccagcccagcctcaggcaaccgctcaggcagcctgcctgctgtttccacatgtgccttgcagatatttcatgggaagcagctcatgtcctgtgtcatcgtttgcatcaggctttcacttaacatgtttttcgggttcatccgtgtgttgtagaacatatcagtagtttgttccttttagtcgtattggcgtagcgtgttcgtttattccactccagcgatggactttgggttgtttctgcattctggctattatgaatcacgtgactttgaacattagcaagcatgtctgcgtgtggatgtgtattttcatttgtcataggtagattcctaggagttcgtaggagcttcgaaatggagtttaagacagaagcctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacaccacagaaacacttaccctttgacccagcaattctgcttctaggaatccttccagaagatagacctccaacaatgtgaaaatacattcggaataacctaaatatccatatgcaggagagggttgagtaaactctagtacagccacacaaccacatccactgttgaggatgacctctgtgaattggtttgaggtggtttccagggcacgtggatgtgaatgaggcaagtaccaaagaacatctaaatgctgcccttgatgtgagaagaaggggatgcaggaagacacacgctccctgcacacttgtgcagaggagatacaggagggcagagccagaaacaaaagagatggtgactgcagagggccaggggacggaggaggagtgggtgccaggtcataggtggggtgcagagggcgagggggcagggaagtggagtgggtgccaggtcataggtggggtgcagtgctgctctcagtacaccttttagtgtggcccagctcttgaaaccacagcaatacttcatatactccaaagtaaaatagatggttaatatcagccaggatgtgggggacccaaaatgaaatataagcggaaaacacacatctcactgtagtacaaagcggcagggccacagcaaagggggtggaaaggaaagtgttaaccttatttgggaaaatgataatgttgactggattctgtgaggctgaagagaactgtacaaaatagtagtaaatttttttctcagtgttaatggtgagcaatgtgaaacgactttatgtgtatgtggggattgaacaaataagcagaatcgtagtggataatgagagccaggtttctcactgtcccaggaagaagttacaaatagcaaaaggaagatggcagagggaggccgtgctgttggattgggataggtgtcagtgtgactctgtggtctttaatagatgcatgtacagcacaggagtaaacataggtgtacgcgttacatgcatgggttagtgatacacctacatatgcatctcctagccttgtccgttgggaagacctagaagcaatgacctccagcaacagggagcacacctaaatatcagttgctgataaaaataagcagggctccttgcagaagatgagtctggaacctctgatgatgctggaaataaggaagtggccaaaatggatggggtgtgtcagagggcacataagcaacctggaggagccccatggccaaagcgggtcaatttgagcaaggaaatgagtaatgatagtataggtgtataatctataaaacaaagtcagtatcactactgatacttcttatattgatataagaagaaattgaaaaaataaggagaagggacatctcttcctgacagaaacattccaattaattggtgtaggagcagtgagaaaatagaaaatcgccttcaggcggcactatggaaatagttacttcaggtgagttccgcgggaggatgctgattagtgggccagagtttggagagaaacaggatatttgcctagtctcgaagtatctcttcctcaagttatttatttattaaaaagggaaaaatagtaactttagaatggaggaagccagcagacaccacgtcacctgggcgatcaagatcagcatcatctgatgagacaagttgcatcatatgccgccccacaccacatggcatgtgctctgtcagggactcctgccacaaatgcacaatcacagtctagtcatggagaaatgtcagacgctccagtagagggacgtcctgcaaaatacctcacctcatcagtgttcctcagaagtgtccaggtcatgaacactggaaacaccgaggattggtctaagcttagagacctgatgactaactgtggcctgtgattctgggcagaatcctggaacagaagccggtattggtggagaaaccaccgaaattcagatgaggtctgtggtgtagccaattgtattgtgccagtgtttattttctgatttcgatatatccttctcccagctcacaacatacaggtctgtgattgatacatacttctcctcatgctcacaacttacaaatctatgattttagaggaagctgggagaaggacataggggaattatctgtactatttttcagccttcccataagcctaaaatttcaacataaaaagttgaaaaagaaacccatggcagaatatgatgggagaatggcagaaatggcaggaccagcccctgtctctgtttcttcccatgtgaagctgtttacctggtttatcttggtctttggatttggtcgattttttttttctaaaaagaaattttaaatatagtcaaatttatcagtttttttcctttatggcttttgggttttgaatcctaagaatactttccctactacaatactcatatttttctttaatttcttctaatagttttatattttgtttttcacatttagcatattgatctatatgaaatttgtttttgtacagtttgaagttgggatattttttcaattggctaatcatttgcctttgtcattgagtagtctgccctttgcccagttatcagaaatatcacctttatcactactaaatgttttctttcaatgatatttcaaattgcttattattcttgtgtgataaagtgattggtttttgtatgttgtgtccacagcttgtcatttgtgtctcatgttttctagatggaggatccttttgggaacatgcgtcttcctttctaagctttgtacttcccctgtattaattggctaggacttctggtactgtgctgagtgtagtgtttggatcatagtgatggctagcaggctgcatctcgttgttgtctttgacgtgaatgcttccagtatttcatccttaagtgtgacattactctagttgttttgtacataccctttatcttgtctagcatgttaccttctcttcctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtggtataagtgcttaacacctggcttttggtgggaaggaggagtgggagtgtatggaaacccctgatttgtagcatttgccaatttccaagttataaatgtccctaccgtgccctatttcaagctaccgatgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctcagcactcctaccctccccaggaggaccccggttctgacctctctccacctttgttctcacttggggattgaataccttgtttattttcacgtcatccttgttttctcttctgtgcacatgcagctctacgttttccccccaagaactgccttggccacctcatttgtagatagcgaaatgcagggtttgtaatgatttttattgaaaaattgagcatctgattattattgtggcactggctttattaaacaatgtaggttctgtgataacttttcttaaatgttgggcattgctgccatgttatattcatgaagttcatcagcttcatataaactgacgtttttcattcatgtgtttatgcagtcattgaataaatattttttgagcactttggataccaaaggtttagcagtgaatgaaataactcagtccctttcttcacagagcatatgttctgctatgtctttaagtcacgtgttttttctatttgaccgtccttgccaattttcccctaactcagacatccacttgtctttgcccctggtattatcttaaatcaactctaaatcaatccgatttcttccactgcttcaatgctagttgacgtttggcttaactgcttatataattatttctgcttttattgaattcttatgatgaaaaaacagaagacttgaatctgatgatttttactttagaaaggttaatgatgaaagtgttgtaatactacagtttggtgaaatggcactttttgtgttgtgtgaactgtcatcacttaatgaggagcaggagatcagcttacagttttctgctatagttctggacatcatgagaccttattccccaccagcatgatctctgtctatggctcagagggagagcaatagggatatggggtgctattcacagccttgcctgggtgactgtgtcttctggcagcttagtggctcccaggggcaggatcctggtcaccagcatcctacagcattgccacatgtttgctcatgctctggtgtcctgtggagtagagctccttgttctcctgtggaccacagtccagggagagtgggggtttccctgtaggaggaggagctggaagactccagatcgagtttaaccgtgggctaggctgcgaaatttggatgcaggccagtggacctcagaaatccatctgttcatctttctgctaaactgatttggatttctgcttttttaatcctttgcaaaattaatttgtctttaatatgaaaatcagtgttttatttttagtaagagaaaataattctattttatttatttggaacaatttaaaagaccctagagatcaacatccttcctctttcatttcctagaggagggtgtagaggagcagagtgtgtgacaggcacagtgggactgacctttgcttctgggcctggattaccatgtctggagagtgatgctttggaggaagtatgggtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcattctctctactgcattacaactgtttgatgagagagattttaaaaatgaacataaacaatttttatggaaatatctgttatctattttttttatatagttataccattggaatttactcttaccttcaggtaacagttgtgaggaccaaatcttaatcctggtaggtgacctttaaatcttagaatcaggaattcggctttagtcaaaagttaactttttccttattattgtgctcctgttggatttttaaaaatggatacattctatttattggtatttacaagtcacttgactagactgatactaatagtatgacacaggaaaaacaaaaacatctttctgtaaattttgaagtaatgaacaatattagggattattccaaaacagagcagacaaggcagaggaaaaccagtcaagctctttatagcttaaatctaaccctttacctgaataataatttaaaaaactattttataaatcaagcctcccattcctgtaaaataggagtaattcattatcacacatttttgtacctttaatttttttttttcttgatggagcccaagtcttaaagatgtcaaaactagtatcatgttccattttctaaagtcgaggctatctcagtcccatttctatagccaacagggtaatctgttactaggccctgaaacccttctgatgagtctcagcttataccccaccccacccccaaatattcacacaataggcacagtgaaaaccaggaaattagtctctgaaataagcagcctccccaggaaggaagcagcatggccactgcccattctgtgcctggacctcgccccaccggcacttggcttcaggaactggactgatccaggcactttgctggggtgcactttggcttttctcaccagttcccagggcagcctcgggtaggagtctcgggtaggagagtgttggaggccctagatctggggctacagggacttttctcacaactccaggcgagggcacaccgggcttggctcttctaggtctggcgactgctcccattggcaggtgtccacaggcctctgcctgacgtccttgacaagaggaagagaggacccggctttctgtgggtgccgagccctctgggccacacagctgctgttctctgacttgtgggtttttctgccgcctcttgcgtttcatgctgtgactctggaactaggtcttaccctgtttggagtgaaggttcggggtgttgggaagttctgtcctcttctctcaggaagaggccctttgactgtgtgcccggaggaggcatgggtgcatcttttctccagggggctcctcaccaggggtatggggagactgtgctgcagcctcaggaatgtcagggtgaagaggccctggaggctgatgcttccggccaagggcttcttctggattttcaaataaagtcccagaacagaattactttatgttttaatttcaggcaaatgtctctcatctgcccttttaagtacattaggattgggtttttcgaccctgcacagcacatgggggctcctcagagaagtgtctgataaaataaaattaaataactcgctttttagcacttcgtttttactggtgatttgttagtcattgattgaggtgattgtgattgatccaattatttgtctgcccatcctgattgtaactttttttatttacaggattttaaaagatagtttcttgatcttaatgttatatttaacgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggcttcccaggtactgtcagctcattttggacccaatactagtttattgcctgaaattacctttaaactggaaaatcttcaagtaaaatttttgagagtttttgattaatcccctaggatacttttgaatgataggttttggggagatacatttggttgttttggcaccactaccatcagcctcactcacgtgctgccaggcgccccgccagatcagggaacatcctctgtacatggaagcagccccgagcactatgtctgcttgtgtttctgctctcaaggtttctacggccctgcacgtgggccctgctgaggccccagactgcttcctcacacagctgacctggtgggcttcctgtccacacagctgcccttcctgtcctcccatccaacctctcgcatcatgttgaggggagagaggggggcaaatgagacatggtccttgctttcatggaaatttctagtgatgcagatgtctgtatatcaagtactcacacaagcagatgtaaagtcataactgtgatgaaggaagaccaattgaggacctccatcagccgaggggcctggacgctcactgagaggcgaggtttgcactcagtctccttgcccaaagctggcagcctcattctgctgcccatgtgctgggcaccttctccactatcacgacttccttgacatttcagtctgttctgttcaagttttggccttccatccctctgaaatgggtcttgctagtcactaatgatctgtctcttgttaaggtcagtggcctgtatttcgtcctggtctcaatcagtgtctcaacaggactgtacagaactagccaacctcttggattctgtgggcagtgccaccctggcatccttctggctcagtcttctgtgcaggtcccccagtcaccaggagccctgcaggtgcagcctacctgcccccagcccaggctgcgctccctgcttgctctgcgtgtgatgctccggcctttgccgtgagctctgacacagtgcagcacagacctgcttgagctctggatcccctccccaggctcctgtccatcctgccccctttcagcttcctgcagtgaccattgcctggaactcaacccagtgttttttctctgccccctttttctgttagctcttcccccagtggtgtggggctgggacaggggcctcacattgtcgtccacgtttcccgaggcttctgtctctccatcccgctgtttcagggttctgcatcctgctgtttcagggttctgcatcccgctgtttcagggttctgcatcccgctgtttcagggtgcacgtttccttctcgggcttggctccttgggtcatgtctccagcctgacgttccagctgagaggtggtgaggcaggaaggggtgtctctgcatcaggaaagcgataaggagttcaggaaacccagtgtctctcattggctggaagagtattacacggctacctctggttgcccagatgcctggggcagggtctgtgctcgagaaaataaggctctgtgagtaagggtctcccacagccagatcaacaaggagctgtaggctgtaagtcctggttcctgactgagggaggcctaaaaagtggggctgttggggctttatatttagcacccactttttaccctctcaaattccagaccagttgagagagccgcacacactgtagataggcaagtggagatcagatacaggctctgttttagataaaagcaactggagaaagtggctgactggccaagcgggtttgctaatcctttatcccaaattagacaaacttcccacctagtaacgagcatggctgggggcaagccccttccacgtggcaggagaagaaaccctagcactttggtgtgggtgcgcctagcccaagaggagaggaggaccggctgggctaagcagcccatttcctccttctagatgcctccttctgcaggaaagagtgcgtgagttggattctgtccacagggaacagaagcgcaagggacaagtgccccctctgctctgaggaagggttttgcatatctcctgttggaagtctggaagctgggcagtctcgctccctgcaccagctgtgccggccctgcctgtcttcctgcaggtctgggctggctgctgtgggcctgtgtcctcaacactgccctgccctgaggctgttggagggacagccccagtgctcccccttcatcatccactctcctttccctttagtgtttctatctctggatttgtttctggtgagccttccctccagaaggaactgctcttgtccccatgtacttcctcgaggcctccctggtcgttcctaggggcgatcatactatagaaagaacccatcattgtcacccagaagtgctcctgagagatgagggaacctctggggaagccagcttgggcttcgggaggaattttctcctctctttatttttattttatttttttgagacagagtctgtctctgtcgcccaggcggtgcagtggcactgccagctctgcctcccgggttcacaccattctcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagacgggtggggttggccctttccattctttaaggagagtattttccactgtgagatggtcacataccttctctttggtaacaggacaaaagagcaaatgctggaaaaactaagcttatgagctttggggaagcctgatgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggacttcagacacatgtgcaaggttctgaggatgcctgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaaccgctgctccctaaaggaaaaggagagtgcctttgcctttcaacctgagctccatgtggtcctctggcccagcctgctaggcagcctcgccctgctccccactgatgtcacacaggtgtcacaaaatgaacatctgaaaccagagcttcattttcctaaatttcctagcctttctccttacagtgaacgtcaccaacacccacccagctgctggaaacctggcagtcatcctagccacctcgctttccctcaccgtcacacccagtcccctcaaacatttgtgcctgctgtccctgcgttcgcttcccacccgggtgcttgcctttccacgtctccctgctgtccagcagctggcaagtcattcctgccctgtgcttgcaggctccacggacccaccagggcatctggaatacaactgtgacttcctcctcaccccacggctgtgcttgacccggctcccatctgtctccagatcccttggagcactctcccaggtctgctgcaggcccatggcctcctcccttggaccactctccccgtctctgtctaggggctgctcacagcttcctagaagtttcttgcctgggctttgcttattcccagctggtggctttccatctgtgctcttcctctgctgacggccccttctgccccagctcattatatgaccgttgtctcccatcccgtcccgacctgcctgtttatggaggcatcctctaggttctcagtggagggtgcctggcccctggaacaaaactgttgagtttgaatcatccccaccctgcctcttcctagctgcagtgctgggcctcagtttccctatgtgcaaaatggggacactcaaacctgcctcattcccgtgaggattacatgattaggtaaagtgttcgtggcagtgtgggggatggcgagtgctaggcaggagctggaggctgttctctttgggctatttgcacacatatgctcttagcctcctttcgagcactttcctcagccttcaatcttgtgtatatttgtgtgtgtttctcttttaggagagagacttctctggcattgactggacaactgtcagagcttatccttgacctgagctcactgcctctgcctcagaattgggggtcaggttattcttagtattctaggtttataaggccagacagagtccttcttccctgtagagcagaaatgacccctaatataggagcatattgttttccctcagcagagcaaatgcttcagtagtagtgttaccagcagacagatggcgctttagaggtgacatgtgatagatgcttgggactgaaatttagccgtggatcatagcctgaatgggattttcacgcatgtcttccctctcaggatttctcttaagggttgttgattccacatttctccttgaggagggggtggtggtagggctggtgaccggggaactgtaatttcctgtgggagagcagcaatttcattattcctttaatgaagctatagttgatcatccttcagtgcctagtatacagcctgttaaattagggtcttcggattgctctgcaagcctttttaaaaaaataatttacaggctgggcgcggtgggtggctcacgcctgtaatcccagcgctttgggaggccgaggcgggtggatcacttgaggtcaggagtttgagaccagcctggccaacatggtgaaaccctatctctactaaaagtacaaaaaaaaattagctgggtgtggtggcgcacacctgtgatcccagcgagcaggaggctgatacatgagaatcacttgaaccttgggaggggaccactccagcctgggtgacagagcgagactctgtctcaaaaaaataaaaaataaaaatttacaatttatgttaaaatatgtcattttaagttatgtaaatccaagcataattactgaacacaaggctcaatccaaaacatgcacagtaagcccgtgtgaagtgttcacatgctgttctgaggctggctggatctggagtttctgggagtgctctcttgggctggcacgtcttgggctgtgggggccctgaagccctcctagatgctggacattggtgtgtgtgcaacttggtggtggtgttggggttactttccagaagctactcaaggcttagtctcagtttctatctaaagatatttatatgggaagtattccaaatgtggatttataaagataacacatggatagaaatagtgtaaaacttgtgtgaactgaaccagccaagcttctagtcttccctttccaaaactttcctttttctccccccgtgttaaagatttaaaaatatatgtttaaaaaggtcacttttaacttgtaaaaattattcaacatatacagaaatttaaaaagcagcattgcaggttatgtgagattatgtatgtctgctctttggaactaggttgaaatgatagctacaaggttctttggaagaatggggatgtgtgggtgagagtggagtagacaggctgggcttactaactaggcttgcactggcccccgtcagtcactgttcccaagtcaaatactgcattgcactgaacaccagagcagcagtgcatttcctagagaactctgcaaggctacaggtggcagacttagggagcgcttgccatccctgcccttcccagctctacccagaacaaggaggcctcgcacactacctggtcatattttgacttcatgcatttaatgaaccaaactaaaggtaaatattttcttttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggccagcggggccagcaggatgagcaggcctggtttggggtatgggccgcaggcgtggagctcgatgctgggcaggggcctgctcactgacgagttgccacccgggattggggtaggggtgggcgcggtggtctcgggctctgagcggctctgcaccggcaggagcaggactggcagcagcagcagcagcgccagtgcggatcgggccgccatggccaagcgctccggctcgtcccgtagcagtgccgcggcggcggccgctgccgggagtgtctgttccgcggttacgcggggtcctctccggtcctgtccagtgaggtcctgacagctgtaccctggcccaacccctgcccacggctgttaacgatcagcctcggggagcaggtgtgccgccacgcgcgccgtagcgctccggagctggctctgcgctcacgtgctcgctgtgccctgcgcgcgggcgggccgtgtccccgcagccccgcgcctggcgctgccaagctgcccagcgggctttagcaggtgctgaaatgcccgctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaaaagatttgctagcgtttaacatttacctcctgtactggagtttaaaggaagcgttgcttcttaagtaatcagtgatccttttgcttttggaaattgtaatgaacttcaccatcgtagagctttaatatttctttcctgaagcagaaagcatgtgaaattttctggatagtgtatacttaatacgcaagcttttggagtttttgaatgctgggtatgttagcacaccagtcttgctgactattacgtgggagatgagtgctgcttaaaattgtgtaaggggtcagtagttacagtggtggacatacttttgccagacatggtttattttaaagtgaacatattttgtgcttatttatttatttgggacagggtctcactctgttactcaggctggagtgcagtggtaatcatggttcactgcagcctcaacttccaggctcaagtgatcctcccacctcagcctcctgagtagctgggactgtggggctacaggcgcactaccacacccagctaactttttttattttttgtagagacggagtcttgctgtgttgcccaggctagacttgaactcctggcgtcaagcgatcctccctcttcggcctcccaagttgctgggattacagatgtgagccaccatgcctggccaatgtgcttattttaattctaaatcagaatttctataattatcttccttaccttggtgtctgtctgttatcagcacaagggtttaaaataatttttgatttcttggaagtaattacgcaggcagttcaatgggagaaggcactttcctcagcacatttggggtgctgttgtcagaaagaaggggatggattcaagtcagcaaaaccagctgtaaccacaactatattttttaaacatgtagctgcatgttccataaaacagcatataaaaaatagagtgagcattctttattggagaaatagctgattctaggactgggcaggaaataacacaagtgccaggaatgccaaggaaatggcaaggaaatgccgagaaacaaacataaccacacccacatcaatgggtggtgtcaaagggacccaggagccaactgaaagagctcccagtggccaaagctggaacagtttctacaacaaaacaaagtagtattggattatagcccagagataaataaatatccatgagtccagactgacataaataaatgactgataaatgaggagaaaagacaaagctccttttccagcacaattccagatcatctctgcatctgctgtatctgctgtgtcttccaggaggtggagcacaacccttaccccaaggcaagggctgtgcagagcaacttccttccagagaggacagcatggaagtggggcggggggctcaacccagcaggggccaggtcagcctcacagtggtcagtcacggtgacagggtgtgcctgatacagtggagtgacagtgggccttcacctctgggggcttcatccccaaactcagtcccttcctgtaccatgagaaaaacatcagacagatcccagctgagggacagcttcctcaacagtcaaaaaccaagaagagtctgagaaactcacagccaagaggggcctagggagccatgacatctcaatgtcacgtgggatcctggacgactgaatctgacgaaagtgtggatttcagttaataacaatgtgttaattaatactggtccgttaaaccagcagtcctcaacctttttggcaccagggactggtgacaatttttccatgggccgaggtgggggctgggagaatggtttggggatgattccagcgcattacatttattgtgcattttctttccatgattacattgtaatatataatgaaataatcatacaactcagcatcatgtagaatcagtgggagccctgagcttgttttcctgcaactagatggtcccatcgggggtaaggggagacagtggcagatcatcagacattggattcttataaggaatgtgcaacctagacccctcacatgcgcagttcacaatagggttccagtcctgtgagaatctaatgctgccactgatctgacagaatcagtgcaagaactgattctctgaagcccagttcctaacaggtcatggactgttacttgtccatggcccaggggttgggactcctgtattaaaccgtgctcatgtaagatcttaataatagaaaatgggtgtggggtctgtggggcctttctgtcacatctgctcaatttttcttcaaatctaaaattgttctaaaaataacgtttactttaaaaataagtgttttttcaaaaacacttttttgtgtccttatcttctgctccaaataaataattatcctgacttttgtgtaagtggttccactagttttctttgatttcttaactctgtctgttacccttacacagtatatcctttggttttgaaaaccgagtagtcagggcacacttatcgaaccaggccccaggggtcagtgacggttgatctccaaggggttcacttttggggaggggggtccctcctggagcagtgcgttcagctagctcgtatactttttcacaagtgtgttctgttcccttcagcggggtaggcctgctaccctctccttccacttgggcttcccctttcttgtctgtctccttgtgcctggcagccttgggtatctgtgatatggctgtggttagttttggtgcagtgggatatatttatgtgctgcagtcacttctgtgaagagttaggtgctgtccgggtgctgtcagcttggattccggagttgtcctgtgcagtggaggctgtaaaggagcattgtcagggaagagaggctgttgctactgtacccatttgactggggactcctgggatagagtgagttccaagaaagagcagggaagaattgggtcagtggagacacagtgggggtcagggcatggacaggccgtgctgcagcttggagatacaaagaatgagggacgaacccagaactggaggtgtttctcaagaacagaatcttcaaaggttgagatgaaactcccatcatacttactagcaataacctctagcaaagttgaggtggtctgttttggctaaataaaatggacatagcattgctgggcccctgtgaagggctggaagcagggaaatgtcagcagtggcaagcgtgccctctggggagtagggaatttccctggcgctggcaggcagcccatgctgccgtagatgtttcctgctgtcctgggtggcctcacacagagcagctccacacctgctctttgaagttttcttggggtgcctgctggctacaaggggtctagatgtttatgacactgatataaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcattgctgcttcgttgttttgttttgttttgttttgttttgtttttttagatggagtctggcactgtcacccaggctggagagcagtggcatgatcttggctcaccaaaacctccacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacaattaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttatgcttgattgcaggcttgttaaatcccgtgggaggcttttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccagtgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttaccaagataccatttcttacagatgtgcaaataatcaaaagtctcacttgatagctatttctaataatgttgctatttctcatgtacgtgcttaattggaaatggtgtattaaataaaggtgaagaggcagttgccttttcagcttaaaagagcattaaagtttatgattgttaacttctaaatttattctcagtgtgctttgaaatagactttataacaaaagcagcactaactctccctagatttcctaggaagcaggtaccaaattcttatgcacctgcatgcacaggctgccaggatgcccccgctctactgtggattattctaggctgtttctccttccttccaaccaccacacccacatccctaaacctaggggtttaaatttaggtaacacacctagggcttgttaaatttaggtagtttccacacttcgaccttttttcttaggatggctctgtattcattatggatttcataagtcacatggctggaaggtacctgatacagattaaacacagaatttagttaggatagcattctgtctttgaaggctgtgtgattgcagcccaggccaagccaggcagaagttgggtcacttgagcagggccctgcaaacacacctgaaggaggtggcattgctaggactctacttttggggctgaatcagcagaggcaaaaggactgagtaagtccttgctgaggatggcacagctctcagctacagagctaggaccagaccaggctctggggttcatgcgggaatcaccagtctgcgctgctgcctcctcctgtatgcgtgtgtgtgtgcgcgcgtgtgcgtatatgtgtgtgcgcgcgtgtgcgtatatgtgtgtgcacgtgtttgcgcgcgtgtgtgcgcgcttgtgtgtatatgtgtgtgcgcgcgtgtgcgtatgtgtgtgcactgtgcgcgcgtgtgcgcgcttgtgcgtatatgtgtgtgcacgtgtgtgcgcgcgtgtgcgtatatgtgtgtgcacgtgtgtgtccccatgagtcctgtggcaccaccgagttgtcatgaatgctttcgtttaacgagtcaggagcagtttcccattttgtaggctgtttttctgtgacctggattttaatggcttggtcaacaggtggaaaagtatccacctttccttatcagtctggaggctggttggttttttctgcgtcgcctgcgtcaccacttcctgatgtcagcgcacggggctctgcgcccccccaggactggaggctccgtgtagatggagacttttgtttttgtcccatcctcctggcatgtagaaggccctcaaatacttgttgaagaataaatggacgggctttggtattttataacctagcaatgcaccttttggttgtttccaggtttactattaaaaccaacgtcttgatgcccctctttctggatgcttttggtgatagagaagccaaatcacgctggttttaagcaaaaatcatgtatttgctcctgaaattttcctttgaaaactttctgtatgcggttgtacgtcagtatgtggttttcagccacactgggaggcgcctttctctctctttttgtcgctatagacattagtggaaagccacaagtagcgtgggggctgcctctagtcacgcttcagctgcaagtgcggtgtgagcatctatttttacctcacagtcctcgctctgaaaaattctgaccacttttatttttaacattctgctctattagctgggtgcagggaggaaggaagctcaaattagtcagtttactttgtatttatttttacttgaccttttcacttccacattttgagaagaaaatgtgagactctttcctctgcataattttcttccttgaggagaaaccattttcagtcatgcttggaaagaggtggagataacctcagggtagcatgtttagcgttttccattcacgaaacaaaccttaaaatgttcatctgtttattctatgaaataattagtttcttatttcccacgaatttgaaaaccagtacatttctgtgccaagtaatggctgtgttttcttgaccatccggcaagtctctacctgggtgtggtgacttggggaccgcgttgtcaaagagccagtgaggcgggggtgtggagaatttgtttgccctttgtttttcacttacctttttctgcaggaattgaactaaacaattgctactgacaatgatgtattttaattcctaggaggttaaactcctcacctagaacagtttgattaataaacctaatctatttaagcatgtgtcaatccttttggaaattgtaatattcaaggacttgctagcatttatggctctttaaatatttctagttatagttgctgtcaggattcatttattttgattgggtaattagttttttaccattattttaaaaactaataaacattttaatcagatctcatggacagaaagccaagattcttgtgctgcttcctaaatgcagtgggcgcatctctgtcagtttttacctgctggaaggtactcctgagtgctgtgctgagctctgcccatctgtccatcctcttgggacactcatccctttcccattctctgctctgtgaggggatggtgctagtgagagctcaggtcgagagggctggggtgctccttcgtctctcagctcatcagcagtgacttggaagacaatcagggtctacctgtgttgttgagaagcgttacgcaagcaggaaagcgcacaagaggaaggcgcagctgagtgaagcattgcagagcccgccaggctgtgccttccacccaggccagcacacggagcgctgcagtccctgaaggcttcctcaggctcctcctgttggcgtgggtgcctgccactgacctctgtgggtgacaggtttgtcactggagcttgtatcctgcaacctgtttgtttgggcgtgcctgtttgtttgtttttaacgttttaataaactttattttttagagcagttttatatttacagcaaaattgagggacaggtacaaagatttcccgtatgccccctgcccccacacaggcacagcctcccccattatcaacatccgtatccggagccgtgtatttgttacagttgatgaccccatgttgacacctcattacccagagttcatggtttccatgagggtgcactcttagtgttggacgttctatgggtttgtacacatttatgacgatatggatccatccttacagtatgcagaattgtttcattgcccttaaagtcctatgcttagcctattttttaactatataaatgcagtcaaaggatgtgtttttgtgtgttttcttttgttcagtattacatgtgtgatgagacttgcctgtgttgttgcctgttcgtttttactgctgtacatagtactctgctgtttgaccatatcatatattcattctgctgacgatggatagttagacggtttccagtttggggccattataagcaaaactgctctgaccatactgatacatgtgttttggtaaagaagcacaggtgttgctggggtggatgggctggctgtgagcacacgcacttcagcgtgagtgggtgatgctggcatggtgcctggttgggcactcaactgcctgctttcaccacactccccatgtggcatcaactgctttggaagtttctgtcttcttaatttttaccattctgggcaggtgtgtgtggtatttttctgtagttttgattctcatggacctgcttactagtgagattgagcttttgttacatttcatggaattctggactctctgagatgcctcccaaagtgcccagctacagcctctgtcatcagggaaggagcaggtatgggaatggtgtctctgcacacctcatgtcttgcctacatccttcttcaagaaaatactggttttccccctgaaaatgatagaaattgactcatcatttttgagtctagctcaggtgtcttttctggaattgccttttttattcggtgtaaagaggcacagggacttcatatctgctatagatgagtgaaggttgcctagacatgcacacaaggcccttggtggacttcccctatccctggggctcctcataacccttccctcttctcttccctggactttctgggctggggccagggcttggggtcgggggtgagccttcctctcggtgtgtatctctgtgtagagttgcatggtgagattcggcttctgttctaaatgcagttgggtggaaataaagcagggatggtcctgagtcacccacattcctcttggtcagtctgccctggtgtgaggagctggcagcctctgcagacctttggtcccacttcccatttgggggatgtaggcttgtgttataaaataggtgaacatgtgatttactgatttactgcttgaacagggacacttttgagagtgaaagggcctgcaattattaatgaccccaagatgacatgtgataacgaggaagttctggggagatcaggtcatgatccccagagttatgatctcaaagatggagagtgtcatagggaggatgcccctctgtgagttgtgaggggccacgtgtgtcctgtgtacacaggccctaaggggtgctggggccatgtgggtagtcataggaagatggctggagttgggaggcagaatgtttaagtatttcactcattgactaaacttagttgagttttatttgtctgtgaaaagggaaatctacttgccttgcttgcacgcctttcctagggatattttggggactaaaatgtgatagtgaattttaaaatattggttgaaatggccaggctcggtggctcacgcctgtaattccagcactttgggaggccgaggtgggtggatcacaaggtcaggagttcgagaccagcctggccaacatggtgaaaccccatctctactaataatacaaaaattagccaggcgtggtgttgcacacctgtagtcccagctactcgggaggctgaggcaggagaattgcttgaacacaggaggtggaggttgcagtgagctgagatcgtgccactgtactccagcctgggcgacagagcaagactctgtctcaaaaacaaaacaaaacaaaactatatatatatatgtgtgtgtgtgtatatatatatatgtgtgtgtgtgtatatatgtgtgtgtgtgtgtgtgtgtgtgtatatatatatatatgttgacatgtgagtttttcagtttactctgaactctctccttgtctgttttttaaagcatcctgaaagggagtgtctgtacagcgtcacctgttaacagccactaggaagctgccctgagagttggacctggccgagctctctgatacttgagcagccctgcccagaggagcctgtgcagcacatgagggttcttcagtattggtcggtgtttcgggagcccttacaatgaatgaacacagctgcagcccagtgacccctcttggacaagtgcggagatcagttttagctcagctgctttctgaatgtttcagatatttcaaactggaagtcacaagtagcttttacttttgcaagcagtctgctgttatgaatagcacgtataagaaaatttataattcagttagttaaaaatatgtttgagcacctgttaaagcaccagaattcttttataaattgaggaaagccatgccatctaacacatatgcggcattaagtgttcttttaataaatattatgcttagtagacatactctacataccaatcagaggttgccatcctaaaccaaaactacatatccagcacattctgatattaggcggtggcttacaccagggaaggcttggaggttgttttggctcctaccctttaaaaggcttaccagcttttagatggagtcatagataagacatggatagtaacagaaaggaagcatggcttatcagctgtgtcaagtccggacacatgtatccccattcacattgctgaactcaggaagatatccaagcaccattgtgacatacttgtccacagagaccgcagataaccccagcaccctctcagagtggtgccttggtgtttttgttcataaagccttgatgctcaggcccatccgtcatcccgggcaggtgcgtagcctgtgtggtggatgccagggtcaggggagggctttgcttttgcagagtctcgaggcttaggctgaatgtgtttttaaaggtccgactatactgaaacaaacattaaaaaatattcaacatcacttaatttttattgcttaagagcttatctggctctcccattggctcagtaatttggttgctattaataacgttgttgaggttgtcatcgtcaccttaacattgtcatcatcacctccagtaatagctaacatttattgagttcttcctccatgcaggaactgtgctgagttctttttctgcattattttattcagcctttgctgcagccatctgcagcaggcactgttactaaccttctcctgccagagggaacgcttgagatgctgcagggtgacagtagcctcagagccagggggctgcattgctggatcttcaagcaggcaaactgccaactctgtgttcataatcctggtcatgggctcgcactgacctgtagagagctggatatggggaatggattggagagcttttatttgaaacaacagcaaagtggcatgatcttttgggaatacactttttcaagtcatgtatccactcacagacaggctttgtgagcctcttgctttgttaagggcccagggaagattttaaggcgaccaaacttccagtgacaaacaatatttgaaattagtctattcctttaccccagaaatgcagaaatacatggttttggatgtttgacctcattggttggtgggcatgaggaggtggtctgctttggtgccaatgaccgtctgtgagtcacagagtgagtgaatgctgagccgctgtgatgggaaagctctctgctgagttggttcagtctgggtcacagagtgagtgaatgctgggccgctgtgatgggaaagctgtctgctgaattggttcagcagtgcacctgcttcctcacggggcattagccggtcagggcgatgtctctggatcactcaacttgtccctgacagagcaaggaataagaaacccagttagattgtctgtatcatcagatgccatttacatcccagtcaaattagcagccagatcactgatttcttataggtatacatcttttgacttcagcataatctcttcccctttttctgcatccttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgtttgctcatcttttaagggtatttcttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtcttctgaacaggatcagtcttggaattggccttttctccatcttcagccccagggtggggctggcctgggtagggcctgcgcctgtgcttgctgcgcagcagcacccctgcgtgccttcccttgcctcggctgctaagtctttggagaaaactctacattgccaagcttcttctgaaagatttaattttttatttagaaacagtatgcttattacagactgtgcagactttgcagaaatgcaaaactaggaagagacatattagtccctttgcatagaagcaacttttgttattattttgtatgtttcctttgtatctgtattagtgtgttctcatactgctaataaagacataccaaagactgggtgatttatgaaggaaaaaggtttaacagactcacagttcagcatgactgagaaggcctcaggaaacttacaatcatggtggaaggggaagcaaacacatcattcttcacatggcaacagcaaggagaagtgtccagcaaaatggggaaaagccccttacaaagccgtcagatcccgtgagaactcactcactatcacgaaaacagcatgagggtaactgcccccatgatacaattacctcccactgggtccctcccacagcacgtggggattatgggaactacaattgaagatgagatttgagtggggacatggccaaacaatatctgtgtcttttttcatgtatatgttttttttttcttttctcagcataattgatatactgtggttactctacctatttgtgtaggcctctcaggtcattgaaacaagatgttgtacaaattagcagatgacactggcgcatggaggaatggtttgtattttaattttcactgtataacattttagtaaagcttttactggaaatgttttctacccatatcctcaggaaaccatgtgaagtagacagccttgcatttcctggattgctccctcgaaggatgaagggagcagttctatcagatgctcttcccagcctccttctccagggagacctagccgctgctgttttgagtttcctgggaggacatcccccaaggactctctggcttgtccttgtgaagttggtttgctttttgtgccagctttttaggcttacaaaatgttgtgtgtgtgtacataggaaaaatatggaagggtacgtacccactagtttgtgtcagcactggattctggcatatataatagatgaggagtttctgttatgtatatgggatttctgagatacacaggggttttctgtgcacatctctctataacgcagctgtcccgtcacatcctgcatgtcagtacaggtagtgccgttctcttcgtaggactgtgacactttatctttgttctttcacagttaaaaaaaaaaaagcttctttaaaattctgactttatataactaacgcaatgctcatgctacttcacttgttacaagaacatattattctgtcctatagatgtactgcagttatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccgtttccagaggtaaacaatgtacagtttgtgttttcttctcttaagttcttcttgtagtcaccattatagctttaacttttctgtttgtgagttcatgtggaagtcaacagtgccttcacactctgagttttgatgagatttatattgacaaggcttaaaacatttgtagtgtttcccatctatcattaggctccctgtgcttttcctgcaagtgtagtctaaacattttaatataagaaaagtaacatttatagtattatgatagtatattttgccatagaaccaagtggtatgaaatgtaattctgcctcaccaaacctttgccaataaaaggagaatattcagatggaactcccagtttctctttaggtgtccgctgtttctagctgcctcagttgccatggtttctcctatcccatggtgttggtttcttggattctatttttgttttgctggagcacctccttaatccacttccttatagaatggatggctgacagacttcttaattcacttccttatagaatggatggctgacagacttcttaattcacttccttatagaatggatggctgacagacttcttgggtttttgcacgtaatgttcaaacatgcaattactttgttctcatacttattgataatttggtagggtctagaattctaggatcgtataattttccttttgaaatcagaaaatattctctattattttccagagtctagtgttgttaatgagaagttggatatccgtttgatccttgttctactgcaggtaaacatcttctactctctccttctctccctccctgggcttcatgtcctgacggtttgatttttcgttaccctaaacccggatctgcttctcttccagcccgcgtgcccatattgggatcaccccttagaaaacctcaggctttctttggagagcgattctcaggtttcagcccaggaataaaagcgttccctatggctcctgcttcttgggaagacccctcacctctgttgtcttgctctgcagtttcctctgctctctcgcatcaacctgctttcgtctgccttatgccctaaaagccctggcaggctttcttgtgttctgctaaatccctctgtaaatttttagcaccgtgcactattatggttcattcaccaccaaaaagtaccttttctgacattttaacagagctctgggaagaatggagagaagatatggtgtactttatcaccatttttaattaaaagcccttttaattaattaatttagaggcagggtctcgctctgtcacccagggtgaagtgcagtagtgtgatcgtggctcactgcagcctccaccttctgggctcaagcaatactcctgttatcagcctcttgagtagcttggaccacagtcacgtgccacactgactgattaatttttaaattttttgtagaggtggggtcttgccgtgttgcccagactggtctcgaactcctaggctcaagccatcctcccaccttggcctcccaaagtgctgagcacaccactgtgcctagcctaaaagcctttttagatcactctcagtggcaaaattagtgccttggtcacctttaccagtagctgttcttgctctgcagtggaaatatcactcaacattatcaaagaatcgggatgaaattaaatgaaccagtttaggtacttttgatacagaagttcttatgagacgtgttgttctttactatgtaagagtgtggccataaacttaaaaatagctgggtaactttgttacacttgccttgatggtgtgttgcaagttagttaaatttcatatactcttaatcagcacatcaccaacaaataaaatgttactgctgcatcagaatttagaggaggttctatacatctgtttcgaaataaagacggagatgacttagggtacttataagttgttgaaaaatcatggctcctgaaactatgaattgtcatcgtggtatatacccagacagcccacattaaactgctgtgaacatgagaaaacggacatcgaaatgataaaagcaagagtgttggtaattgaaatccattataaataaagctgtcattggtaacgcacgaaatgctgtttctgaggatgaggactttgtggcccccacgtgggcgcattaccaagctttgcagctctgcacaggagcctcccttcttgatactgaactagacctctataaagcctagtaacacctcaggtttaggttataaatcttaaattttagtgccccgtaataattcacttcgtaggttaccatggactagcccttagttgcactgagaaaagaaaggctatgaaattttgttggtgaagtgccaaagaaaggattgggttttgggtcatctcacagcccatggtgagggctgtctttggcctctaccgcacggacaagtttgcatgtcagatgttggcacacttgtggggtattgggttcttttgaatatctgattaaatccatttacattttcgttagaaaaattcatctgtgcatatgaacgcatcatttcatatatgatttcacacttctcattgtcttcctgaagcccattcgtgaactgtcgattgaatgcctgctctggagaggagtgtgaagctgcacttcttccgtctcctcctggcactcgctcaggatcctcacaggtgtggaaaacactctaaggaagcctgcgaaggccagatgtctcccttttgccttctttggttctgttcatgatggccttatcacggacacactaggaccctctgaggacaccacccctgccaccgcattgctctgggggcaacttccgagcttattgtcttcctccagcaagggcaggaatgtggagaagctgtgtgtgctgggcctttactttcattattggcgacaatgtttgttttcattttatcagctttctttatcctccatttttttatcttccacaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttggtatgtgtgtattcaactcaggtgtgacctactgtcttttatatgtccctggatttaaatatgctaattttgttatgatttttgtgtctacatttgtaaaagccgctgatagttcatgtctggcacattcttgacagattttactaccgagattatactgggctcgtaaaacgagtgggggatgttccctgtttttttgttcgctggaacggtatgtgtaagctttgtgcttttcctttattcagccagtgctttcacatgctgcttccttttatagccactcttttttgctacatattctttctctacaagagcacagttcttctggaatgtgtcccttaggattaactatctcaggtgtgatttgtgtgaaaacatctttattcttattgtggaaagactgttgttaggtggggagtttactttcccgtctgcacattgaagatctcatcctgctccactactggtctcttccctgggccctgggcatccgctctcagcctgactgtccccctgtgctcccgcatcatttctctgtgctgtgtctgggttcatgcttatttgtatttattctgctgcgggttagttggccgaatctgtttctgtgagagctcccatgcttttggtactttctgtctctcgtgtgtctctgcactgctttctgggttattgcttcggttctactgcccagtttggccattttctctttaactgtgtctaatatgctgctaaaacctgtccactgagcttttagcgttagtcattatagctattatttctggagggtctctctgcttccctgtcctgccaagtccaattggtcattcttagtttacctgtttactaactgtttgtatctcctttagccgttgttttctgtacgtatatggtgtgtttgacttttccagcatgttcaaggctgttttcccagctgtatcccctcctctcgggccatcaactttttgttccccattgttgctactaattcttaggactaataaagcacttcaaatggcagctactgtcaaaaattaggaagaaggcttctttgccgtagcagcctccagttgattactttctcttgacctgtactttacttgccacgagcatatcatgcctctgtacttgctgcagtaattactgtctcgaaacagtgaaatctcatcagttgcccatatgtgtttaactgcacacgcgtgcatagtcttggctttatgcgaggtagaaaatgagagtacttagtttttggcagagcagagcctcaatttccacagtctaattaaattataatgataaatatcactttaaaaggaaacagttgcttcgtttaatcaatatgattattactggcacagcaaatccatcaagtgctgtgaatgataaatgtgttttaatacaacttgcagtgtacttgctgttggtacaaggcatgttaaatcctcagtggtccctcttttcatagcattgctgtggcactggcatttccctttgttaggagatagtggggtataaacccattgtggaaaccccttcagcttgacaaatttggagtcatgctattttcagaagaggatttcctgcgactaggagcagtcacccagagaaagctctggaaaggtggtggtgctggggttgaagatgagctgctggcccctggcatgtcagtgggcggaggtgggagacgtgcagagctgcctatcccacagtacttccctttccccatccaccctttcaggtggctcactccccaccagtttcgcaggatggctcaaggcaaatggagaaaacggcacaggttgaaactcttggccgtagcttgcgagcttgcctcttagcacctccaaccacgatctccttgaatgtagtctcctcagtctctcttttttgtgtgaggaatataaagtttctagttgccttttcgcataatctcatagctcttctgcacctgtggttccttagctcttatctgagaccgtggcaggcagacagctggttgcagtggttggttagttgtttcatatggttgatcatacagcagctacttggtcccattgttattgatagtattgtataaaatcagttgtcattgctggcatttttttttgttctgttgcctgattatttgttttctaatacatttttattgtgagatacctttcttgaacatggacacatatataagagaataattttaattgcatgtccatgtaactctcacccaggttaaatagacactgtgtacctcacagtttccttcatgctcctccctgatgataactccccctcatccatatgacacatctaatatatactacgtgtgtgtgtgtgtgtgtgtgtataattaattataattattattattttgagacaatgttttgctctgtggcccaggccagaatgcagtggtgtgatcacagttctctgcagtctcaacttcctaggcataggtgatcctcccactgcagcttccagagcagttgggattacagacatgagccaccactccgggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgcagccttgaactcccaggttcaaacagtcctcccgccttagcctgctgagcagctgacaccacaggtgcacaccagcatgcctcgctgagtttttaattttttgtagagatggggtttccatgtgttgcctaggctgatcttgaactcctggcctcacgtgatcctcctgccttggtctcccagagtgctgggcttataagtgtgagccactgtgtttggtaatatcctatattttgaaataatactgtccttttctttttaattttaccatgtaagaatgcatccccaatcaatgtagttcagttttgcctgtgatggaactttatccaaggggagtcatcagtatattcttttgtgtttctcttgatttattaatgaagtggattacataaatcgattttcatacattaaatcatgtttgcattcccatcataaattcatcttaatcatgtttgatcgctttaaaaaatattattggattgagtgtgatcacattttgtatacgatgtttacactgtatttgtaagattgacttactgcttccttttcatcttcacagaagtgtcttgttgaatgttggattcactttctagagaagccatctagtcatggagtgttctttccaggatgatttttgtttactgactataatccatccctccctccctgcattccttccttccttcccttttcttctcttttctttttcttgagacaaggtctcactctgtctcccaggctctagagtgtgatggtgcaatttcggctcactgcagcctctgcctcctgggctcagacgatcctcctgcctcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgatgtgtgtgtgtgtgtgtgtgtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgcacccagcctaataagttgtatttctcttggagtttcttcatttaacctaagcttacaagctttttggaataaagtttataaagcctcttactatatttttagtgttgtcagagtttaagtgataattccattttggtttctcttgccgcctgatgacccattcccaacttagtgacataaacaacaatcactttattaatgctcagccaggtagcctgagtgtctggagctctgcttctggctgtcagctgtggctttcttggttcttctcagtgtcctgtatgagaaggcttcttcagtgaggtggctggctcccgcctggggctgactagacatccttctctgcatgtagcccctgtgatctcttcagagcatctgagttggctccccagagacagtgttcccagaaataggaggtggaatctggcttcctcttcaggtgctggtctggacctggcagtaccacgcctgctgcgttcaatgggccagagcagtcacccgcctgctgggactcattgggggaagtaagatcttcccacacaaggacaggagagtcacattgtggccatcaggccttcctgccctccaattcaattccaaggctggttaatttgggctttttctcttgtgttccctttctgtgtttccatgagtcttgccagagatcactggttcactgcattgtcttttcaaagaaccaatgtttatctttgtgtacctgccgttatatgtaattaatacaggttgaatttcttactagttccctttttctgttttctttgagcttactttgttcttctctccctgacttgttcaggtaggcactctttaatttttttactcctattctagcttgagcaccgagctataaaggtccctctgatgtactgctttatctgtgtgccacacaattctgtacataatcttttctagttttaagttctaagtgttttctgttttctcctgtgattattttcttttgtctatggattatttagaagtgtattgctgaactctcagacatatgggactttctagttatacttggcttgttaatttctaggctcatggtattacgatcagaggatgagctctgtctgatttcagccacctgaaatatgttgagattttctttacggctgggatatggtctatttttagaagtggctcatgtgtccttgaggagctgatgtgtgatgcactgttaggagcagcgtcttgcatgtgaccgccatgcagcttgttaattgtgttgtgcagatcttccatctctccactgttttgttttttcagccgctgtctgctgtctctgtcacctgctcctctccactccctccatgacaaaaagactccggtgtttttgaccatcttttattgcgcccctactgtgatcttagtcacggggccaagcactctacatctgttcctccatttaatcctcacggcaccatctgcggcgggtgttccttgtgtcctcgtcctgtcctcataggagcaagcctggaaggggctgagtcactgttcaagtcacacgactgcaaggctgaggtctagggtggtggcctggacccctctttcctggaagccatgcttttcctgaaaccccttgcaatactcctggcaagtatggcagttttacctcagttggtatgagtgtactcaaatgggaggcaaccattctcacacttgatgtttagactttgcagcttccaaaacccactctgcatatcacctgctccctcctcaaagtggctgggcttcccatgcagtttcccatcctgcagacggcccagggaggtcagatttcttggccaggcttgcagagttggtgggacatgatgtgggcactagaacccagttctgtaaatcttggtttcatgtcctttctgctgtgtttttctttctctgtttaggcggtggactttttggtgtgtaaagcttctagaatggattttacttctttgtggctctttggattgagggaggggctaggtgccatctccagagaagcttgttcagctcatgctcactcggggcccttgctctctgcccactggggaggggctgtggtggagctggattcggactgagtggaggcaacgctgaaggtcagaggccaacgtccttgcacttcttgacactctccacccaggcgtggtgattgggaccgctggggagggtgatttgggagcttgaatctggtgtggggatgatgggggtcattgatagtggggacagttctggacatgtggccctcattctctgtgctggacaagatgactctgtgacctgtaattccaggctgatagagcattttcagtgacagcccatttgacttgatggtgctagtgcaggacacaggtgagcttgtctctgtgtcttaggtctgtcccagcagacgagctgacgtgtgttgtagatgaatgtcagctggtcacaggtgggaggtttggaaggtagcctccaatctcctctgaggactgcagcagcgaccggggcagcaggaacgcattgtgatggcctggccaagtctgcatagcgagagtcgagccactttcacgcgcaccttatcccacacttcacctccttcctccaggttcccactcagaaacccgctcacccctggacacacctcccagagacttctctttggaactctgcaatggagaaacccattgcagacttccccttcttttggatatcagtttgcttttcaggaagaaaattttaatactccatattgaggttttataattatattagcatgttgaaacattttctctaatggcttgctggttgaaaacgctttcacacagagcagaaactagatggagatactgtttcacaacctctgcttcagaagcagaggtggcctgtagcttccaaacccgggcagagcacgtgcagggatggtgcgtctctgtatctggactcacattcacatgtgtgcatgtgtaggggtgtgtgcatattgaattgtaaaaaagatgagtacgtgtgagattctgcctgagactccagtcctcagtgtgtggcctggtgccgctgatgccgagatgttgggctggcagcgatctgcctccgtctgtcacaggtgcctctacctgctgcaggcagacggacggagacgtgatggattgcgcatatcccctttacagattcggaagagtacatttaaaataacttaaatttgtatttagaagacttttcatggagagtatttattgttatagagttcacttctgaaatggtgacaaagcttttgatactgaatcaaacaagtgtgaagttaccgaatctctctgttacacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaatcttactgcagccttagctcacccatgagtccctcctgcttgttctggggtggtgcctgctgccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggctgaggcaggcagattacttgaggccaggagtttgagaccagcctggccaacgtgacgaaaccccatctctaccaaaaatacaaaaattagccaggtgtgatggtgcacgcttgtagtcccagcctcgggagactgaggcaggagaatcgcttgaacccgggaggcagaggctgcagtgagctgagatcatgccgttgcattccagcctgggtgacagagcaagactctttctcaaaaaaaaaaagaagaacatttctttagtacttatttttggcgactatctcatgattcagcgtctgcttttgagagaagttgtgacaaatactaaaatcccagtaaaattagtatggtgtcagattaatttacttatgagcagctgagtgactaactcaggaagtccagttgtacatttccagggaagctttttcatgggttcagatgagatgaggggaaagagaaggtgtcagagggctgctgctggctggaggaacgcaggtgtgctcctgtgtccatttgctctgtggatactgacgagcgcccactgggcctcagatgccctctgggcatggcagggaccaggcgctcgcttggcagctctcatgtgagccgctcactggacacagccgtgctcccgcctgggagttcgggatggcatgcagagctgtggggagggagcggtcaccagggcgtgagtgtggacagatgggagtggctggtgcagagccataggtagggggcggtcaccagggcgtgagcgtggatggatgagagtggctgggagcctaggggggacgccgtctttggggagtagagacacacccatgtctgactactgggttttgagtttgtgccagcaaaggtcctgcttgccatttctgtctgtaaatgtcaggaatttcaggtaactggttccctagcgagacctttaaaggaggctttatcttcaaccgatgctttttttgggggggtacacaggcagtccaagtatgggaaggtcaaaatcaggtcacctttatcatggcttgtgctgtgggatgggattttattttcagccacagcgcttcttctagcttaattagtgataggaaatcagcttctctgtaaccagaggttattgaaagaatgaggatcccagagttggaatgagtctgaaagagacgttgtggtttaatattgctaagttaagtgtcgatttgtgactacctatttttaacatgccacagaagtaaaacattgcattaattatgccatatatgtgaaatagcaagtatttttatataatataactgtgcattggagaaatgaattatttataatcctttgcaccaataaattgttcttaaaagcatagaaaaaataatcaggccagaaggagatatctaaagcatgtgctgagaaagcaaaactgaagagctggaaattataaaatattacgacatgatgagtcatatctcctcctcctgattctgtgttactaaatgctagctgcgaatagaaatcgtgtatttcctttctttcataaaataagagctaatttcggcagcaaacagtttggcgtgttattcttttcccttttcagggtggtttaaataaaaataaataaacatgaaagattttggctggaacatctttggaagcacggccgtcctcagcctcactgcactgtctggtttccctctgagcctccctcccgggtcctgccttagtgctgtctgtgccgtgtagccacaggtcgcactgcagggctgtggggagttatttttagtttcaggcagactcactgtttttgcctttctttttgcttgaaaagactgaagttatttcttgtgtttttatacatgagattatcttctgaggctggaacatcttggggggatacaatagatagaattcctatagtaattcccctgcgcaagaggaattgctgaggagggcttcgggaaaccttgactcttgttgaagcctggaaagctttctcagtctttctcattgccaccccacaccacatcttctttttgtaacaaatatttattaactcatctttttattttaaaatgaagttcacagaagatattaccttatataattatagccatataatgttaaaaagcagtgtcatgctgaaatgtaatataaagagaaactgaagatacataataaaatagttttctatgccactgtatggacatttaggcactgctgctttcactcggatcactgagtggtgtgggcctgtcagtgcaggcagatgtggggtaggtactgagctggtgacctgaaaaccataagcaatagagctgagtggcattactttctgaaatggtcaaacctgaaggaagcagtgttcagtcttccctgtctctaggtagtctctgtatttctggaacattgagtgtatgttaaaagtatagaaaaatgcattgtgtcaatccaaaactcagctgggctgggcttagagaattatgagcagcctttccacctgcatggaagtccttttgtgcaggacagttctttgtttccggggtggccctgctccctccaggaggtttaggagtgcccatgtcaccatgatgcctacgccacttctcatgttgctacctgttgctaccaccgggcatcgctgccgcctcctgctctgtgcacagtgtggtgtggccgcctgaccgactggtcaggaactaaagttctctcgaagccttgactgaaaggagaagtgaggaggggcatggagcccagtgccaagaggcagctgcgtctttaggggctggcacttttcagaggggctcttggggccagaaggaaagagccgtcattcaaggcttacacagcgtggaggtgccctccctggggtgtcctgtgtgctgacctctgtcctggtgcctggcggtgtcctggcgcagagctccgcaagcctctgcggggctcttctctgtgtggaggttctcgagatgggcagtccgggtggatggtcaggccaatgagggccttcgaatgaagcacattattgtaaggatgctaattctggatcctcagatattgtgacaaaaacttgacatttttcttccttcaaagtaatttattgactaaaataaccaactgagcaaaggtgatgttttagtatctaaatattccaaaagattactgaaattttaaagtaaaaatttggccaagaacgagaagtctctgaatgtgcttttctggcatgacccctgtcaccaggaagctgtcagtgtggtgttgggcctgattgattcgcatcagctcaggtggcgtcctattggaaggtcggcagtgggagagcagctggccaggtcagaggattcatttctgtctgaagctttgtgaggaactaagatggcttttccagtagcctctgtcattccagagagttttaagattgcttttatttgttcttctaccctggaactaggaagccagacccaagaaatgtatccacaccaggttttgcccatagtttttaaaaatgttgaatttctttaacttgaggccctcacaattttctgggcccccataagttatagaacagggaccaggcctgctaccttgtgggggctgggtgggcactggctccccagggcacagatccttcctgtgggtgggcttaggggatgtgagggattcactttcagatgtgacactccagatgtggggttggtggcacattttttttgtccggttacatccaagtaaaaaggaggacaaattcttactgaacctatgcagtaaactccattgtcaggaagagtaaagtgtcttagcatgagtgttcctgaattctgaaagttcaggagagtaagatgttacctagagagtgttttatttcagctttgaaagcagagtctactggatttagggctagagatagacgaagaagaaagagaaggggcttctttgagcgcacattagaaaatacaccataaaagaaaataccgacaatcttccaaagccacagtcagcgtttccctgccagctcctccagtcttccttccttcctgtctgctgggtggcggctcatctgtcaagttttcacagtcatgtgcttctgggcgcaaagccctggtgagcccggctcgtttccctggtggaatcggacagttgtcgaaggggtgtcagcctctgttcagaagcctgagcccctgattctgttccttgaagtgtcaggagttaaggtgcctgtattgagcaggggctgccgttgcttctgactgagggtcctcttcaggcccactggctcttggcagagctcagttccttgtgaccataggcctgtggcgcttggctcctggagactgcccatagcccctgccctgtggccctcttcccagcatggcagtttgcctctcaaggcgtataggcagggtctcccctcttcctttcctctctgacttctctcatccttcaggggtttacctgatcaggccaggcccacccaggaaaatctcccttttgatgaactcagtcagctgatgagatgccttaattgcatctgtaaaatcccttcacctttgccttatgtaacactatatcccatcatgttcacagttcctcccgcctgcaaggcaggggagtgtacaaggtgtgtaccccaggggcaggatgctaacactgcactgactgagaaaagaatttgtcttacctgtacctgacaggtgtgtacctgaaagaggtgtgtgcccgacggtgtgtgcgaccgatgggtgtatgctcgacagtggtgtgtgcgcccaccgggtgtgtgcccgacggtgtgtgcgcccgatgggtgtgtgtgcccgacagtggtgtgtgcgcccgatgggtgtgtgtgcccgacagtggtgtgtgcgcccgccgggtgtgcgcccgacgggggtgtgtgcccgacagtggtgtgtgcgcccgacgggggtgtgtgcccgacagtggtgtgtgcgcccgacgggggtgtgtgcccgacagtggtgtgtgcgcccgacgggggtgtgtgcccgactggtgtgtgcgcccgacgggtgtgtgtgcccgacagtggtgtgtgcgcccgatgggtgtgtgtgcccgacagtggtgtgtgcgcccgacgggtgtgtgcgcctgacaggagtgtgtctgacatgggtgtgtgagcgcccggcaggggtacgtacactcggggtgtgtgtgcctgacgtgtgtgtgtgtctgacatgggtgtgtgcacctggcagaggtgtgtgcgcccagcagaggcatatgcctgacagaggcgtggcttagtgttcagggtccatagtacatgaagaatcctacagatccctatggacaaggcagtacagtagaatttggggcaaaagacttgcacagatttttttttttttttttttacacaagatgaaattgaaatggccaatgagcacaccctcattcatccagcgagcattgaggaccccctagaggccaggcccatgagtgatgaagatcccgaggatgaagacgccttgccagccaggtcagtgggtgatggcatttgtggtcaggggcacccagcaccacacccctggctgccgttgacagctgggtgagtcccctgctgcctgggcagagccacctctgcagatgcccaggtgggtctcctggggcagggactggcaggctgtagcctgtgagcagattctgggacctgaaagctaaggatggtttttacatttttaaggagttataaaacaaacagaaaaggaagaatctgcaacagagaccataagtggtctgcaaagccaaaggtttatagaaatgggcagacctgctctaaggggcctgcttgctgatggggccttgtctggattgccagttctactaattctggaattggaagttctcatggaggactgtgtgctgggtaggatttccagatcccaagatgctttggctgcattcaaacccacagggcagagagagccctccgccctgttccttggcagaggcctccacactccgtgtgctgaccggcctgccagaatgacaacaactgtcagctgtctgcatcctcctggcaccccttagtgtggctgcatactgaggggagttaaaaccataaacaggtggagaatatctccttccagggaatctcagaggactcagtgatttaagaggaaaagaccaaactgctgctttcagcaggaccactgtgtgctgcctgcctgtcagtgcatacagatacggggtcctgagttggtgacctcaaaaccgtgagcggtagatagacagagtagcccctaatgaagcagaaagactagaagagacaggacctaatttaggtcgaaaagcaaagtgaggcctcagaagatgaaggcagagtgcgagaaaggctttctggaactgacaagtctgccatccacatttcgaaatgtattagaaaaattggaaaaaaaacatacgaagtgtagaatgtcagcagaaaggtgtggccacagtcaagagggccctctgtgggtcctgtggtcctggactgcaggtgggcccagtggagactgtgctgcccctcaccctccccggtgggtcctctgtgatgggggtgggtgaagctgagtgctgtcctgaaaatctgaccatgcacagcccctttccaaagacccttctaattttagaggccgccagcagccacgggactaggcagcatcagagcagggacacaatgtgagtcatatgcgcctgtgttcatcctgtggtgtccctgggcccatgggggtgggagggatcagagggatcggagggaggggagtaaaaccaggggaaggagtggaggaccacgaactccctccccttcttggtggccagctgctgtgaggactcgctctcttaggacaggtccactgtctctgagctctggttctggcctcctgtcaggtgccctcgtgcgggaatgagtgagggacagcagggcaggctttccaggcttccagcaagctctacatgatgggtggggagaccctgctcttaaaaacatgtggacccttagcattcttcttcctcagacctggggcctcagcctaagctgagatgacagggaagaactacagatacaccagatttagggaaaataacgtcaagtggtgcagacaagtggaactgctgcttgtgaagtgggctgtggagtcgtgatgtttgctacgcccggcaccatgtttcagaacctgtagcagcgctcaagagagaatcattcctttaacaacaaacatgtactgagcccctgtggggaggcactgaccgaggcctggggacaaatgtggggacagaccagtcctgtggggacagctggcgggggtagaaaacagtagagctgccccaccagccagcggctgctgggagagcaggggtgttcccgcacccagaggaggcaccctgccgctctcccccaggttgcttggtgtgtgcgctgcagggagaatcccgcccccagctggtgtccacaggggccagggacactggtaggtaggtgtggaacaagggagtttgtgacttgggattgttttctacttaaaaaataatctgagtaaagcttggtttaaacagcatcaagttaaaaaaattcctaagaagtggttggattcccagtttatatgtggctttaaggttctgaagaagtacacaattaaccacagaagtatgacttgaatagataagaatttaacaaaatacacactgttgggtgtaaaatcataaatatctgaagttcttagaaattggtaattttcttttagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagccgcttgtgatcctgatatgtggagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcagaggacggtgtgaggatgtctgcgttcagtgatggagcttggcctctgccttgcccctgattgaggctctgagggttcagatacagtctctgcccactgcatgtgaacagcctggtgggtgtggaggggaggaagcctgtgatgatggtggcactgtgaggaaagtggggatggaaggaggtgtgcccaggaggcagggcaggagagttcatggatgtagggttgcagcaagtctggaaagctgggtttgttttccagggagatggcatgggaggtgggcaccccaggcaggaggggctctggatatgactccagaagcctggtgggctggaggggagggagaggctgggcctgctgggggcaggaaaagggcagacctgtgcttaatttcaatttctatgggagtgatgccctcaaacttagaagggcttttgatgagaagcgatagagtatagctcttgccctcctcagtggcatcactgattttttaaaatgcattttagatatttgtatttctatattaattagtattaggattggctataagtgacagagatgcaacataataggagcttaaccaagagaaagggctgcatcctgcacttgctattgtttgatttatgaactttagacattaactgtgcactgttagttcacatggaggaggatttagctccgtgacgtttctccaaccttcttttcctgtatcatttaggattgattctgggtgaaggtcacagcatgactcacagtatcttacacaccttggatgtatatacgcacttcttatgtcgtaagtaatccagagggaggagtttgctagagctagtccagagttcagccatcttagggctctgggtgagtatcgctgcagtacagcagcagcagctttagacaccacttctgtgtttaaggcaggaacaactgagaaggagcaggccgtggagctcttgtctattccttttgtcagagacattgtggaagccctcagcatattttcacctgtctttcaccagaactgtgtctttctccttggcaagaagtgtgttttgtggccagctttagtcacaaaagagacagaaaatgagcctttcatttttgtggcacccttggtagaggggtaggggaaagggcttcaggacgagcactggatcagcttaccaagcctgaaaccacgccccctgctggtcatcctagagactgagtggcccatgtgctcgtggcctgtgggccctgggcggcctctcagtttcctgcatggaaggcagcagaagcacttatccggccctcagctcctcggtggtgtcagtttgtctgacctctgtcagtttgttgtcttcttttttttttttttttaagacagagtctcgctctgttgcctaggctggagtgcagtggcacaatcttggctcactgcaagctccgcctctcgggttcaagcgattcacctgccacagcctcctgagtagctgagactacaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttgtttgtcttctgtgttaccaaagtagaaaacttcttctgttctgtaaccttggttcaatcaaagttccaaattcataaatggcacttatattattatgacgattgctgaaagtcatgccacagtttaatttgctttatacttggatttggtatacttgattttttggttctgttttctctttttcctgatttccttgatttttttggttccgttttctctttctcctggtttccttgattttttggctccgttttctctttttcccatattcttgcctggcatggagtggtagagcagagtggggaatggagttgagtttggatccagcggtcgagcaagtgtctcaactcccatgctcagcttcctcctctgtcacgtggggcagggaaggtgcctgtcgggcgcagcgagcgtggtgagtggtagtgtggggccgcgtgcgcccgtgggccctgagcatcagcacttctgcctctccgtgttctcttgttgagagggaccactgcctttcttatgctatcgccagccttttccagcttattcattctgtttcttggaacccatttaattcattcttcttgaaatatgtgtattttctattttatttcaaattgagacttacctttcttatagaatttgttttcttctgggatctcttgatttttttaaaattggatttactgaggtaaaatgtacagacaataaaactcttttttttttttttttttttttttttttgacacagagtttcgctcttgtcacccaggctggagtgcaatggcatgatctctactcactgcaacctctgccttccaggctcaagcgattctcctgcctcagcctccctagtagctgggattacaggcgcccgccaccatgcccggctaattttgtatttttagtagagatggggtgttgccatgttggccaggctagtctcaaactcctgacctcgggtgatccacccacctcaacccagccaaaaatcattcttctaaagtgtgcactctaatatattctgacaaatgtatgccagtgccacaccaccaagcagctgaggtagagaatattcttaccccaaaaagtttcctcttaccccgtgcagatgtcctacccatcagggcccagggcgaccttgtctgatgttgatgtcccatcagatggtttgtattcagcagagcacctagaccaggctgtgaggtacaggtccgcccctggcagcccatgccttgtagcttctgggtggctcctggcttggttgctgtggtgtggagcgttgagtgacctctgcagaacagcagatggtgctgtagggccgcttctaagactcagtggaggaggctcagtggcgttctgagcggtggccaccaggacaaacctcttgtctttacaccatctgtgtgtgtgtgcgtgagtgtatgtgtgtgtgcattccagtgtgcgtccagaagccagtttccttcagaaagctttctgttccctggcttcatttttaccatttagaggacctgtgaagcaatgagatggaatacttatagctggtttaattcagtgagtgatctgaattgtaaataaaattttatcaagtaatttataaatttgatataataaattaagtctgcggaaggggctgattgtgttatggaatgagaagttttgtacatcttttgcaattctaaaaattgtggccaggtgtggtgctcaagcctataatcctagaactttgggaggctgagacaggaggattgcttaagcccaggagtttgagaccagtctgggtaacatggtgaacccctgtctgtacaaaaaataaaagtaaaaataaattagccaggcatggtggcacatgcctgtagtcccagctactcgagaggctgaggtgggagaattgcttgatcccaggagacgggtggcaatgagccaagattgtgccaatgcactccagcctgggcgacagagcgagaccctgtctcaaaaaaaaaagttgtgactttgctgtgtagtctttgtgtaacataattttatgattctattgttttaagcttaatattccaaataggtaataattatgttaaaatgcaaaaaattagcctatactctcatgatctaaatatgtagtagtggttttacagaatatatttcaaaggattgccattctgttttatttttagtagccagttatagaaagcattatttttaaataatgcctaagaatctttaaagaaatacctgtcaatgtatgttccagtttagtatcaaatttatattcagagctcataagaatttaaaaagtttcccagagtctgtaaatggggatggagctgtccttcaagggtgatagtccccctaggtttgagttgtcctctgctgctagcatagtaccacctgagctacctgtgggccaccttcaccacccgtgggtccctccagccaccccagggacaccttagcctccctgggtcgccttagccacccctgggccatgttagccaccacaggatcaccttagcatccctgggtcaccttagccaccccagggtcaccttagcatccctgggtcgccttagccacgcctgggccatgttaactaccacaggatcaccttagcatccctgggtcgccttagccaccccagggtctccttagccatcccagggccaccttagccacctgtgggttacctcagccaccagtgagtcaccttagctaccccaggatcaccttagccatttgtgggtcaccttacccaccctttcaccttagtcactcatggtcagcttagctgtttgtgggtcacttagccacccctgggccactgtagccacctctgggtgtccttagccacccccgggccaccttggccactctgggtcaccttgtctacccctgggttacctgagccacccttggtcactgtctgtgggtgcttgcttgctttaagccacattatgctactgcagctaattaaggtcgctcaattcaagtgtctcctttttttgggctcctgccttctttttgtttttcaaatcgaacacccgctatactcatttgagaagtgtagactttgatttttaaccctaagttgcatggtaaagtcacctttaaagccaatggaaaaagcttaattgaattcatttgtttgaagaagtagaggaatgttgcaagtagactgaaagttatacttagtctgttctgtttgaaaccattctcattcagaaaacagaaatgtgtttatgtaaagaaatatgttacttgacttaatattgtaaggaatcttaattgagaaaataagtagttgtgttttttctttaactgggcagcattgtagcggggtggagtgtgggtccccaggttggagagctctggatttggagtggatcctagcacatggccaccatgtgaccttgggcagtgactcagcccagctggctgccaggctgctccccatgaggtggtgggagccgtgtgggatctgcctactgggtgtgcagctgctgcggcctaagcggcgtccttgcttggtccccccatgaactcaggggtgtggcctggctccgtcatgtgttttgcagggggatctgaggggcccagaaggtaagaaattgcctacggcccttggctaatagaagagggagcagggctttgaccagggggaccagctagtgactctgtgctggttactactttaccaacaccatggccatgctgcacagctgtgcagcctccacccacaaaggccaaagctccaatggcatctgcgatgcttgtaaaacaagtagcagccgtgtccagcctgctgctctgaaacctcagtctcctttactgagatttgatgatgtttaaatgagcaaatgcatgtgtagtgattggcaggtggccatcgctcagccgacttttcctgtgccctctgcttcggcaggtgcccttcctggctccctgcttcttcctctcctaacctcctggcactgtgctcctcactcaggaattgcacccagcatcacctctgcaggtgagtcccacaccttccccctgctctccaaactcagaccccaagtccagcagcatcttctctcaggcatctatagacctccacaacttaagacatccaaattctcattcccttgccttgccataatcttcccatctcagcagctccttccttccaggctctcaggctgaaggtggcctatcctttcttttctatcccacatggcagccaggaggcctgtgggcggtgccttcaggacatgcctcttgtgcccctgtcccctactctggcctgagtgttccttttaaaactaggtcagaactagattaaagcccgtgtccaagatgctgccacagtctcttgccaccatatgactgccatgtcctcactgtggcccaggaggtcccatgtgcagagccgctggacctccgtctcctctcactctctgttaactgtgctgctgtcagactggctgcctggctgttcctgggcggtttcaggtgctgcggctacctagaaccttccatcttcctttcttcactcttcccagaagagaacactcttcccagctgtcttacggccagcttcctcaccacctcgctgcagtcttttccgcaatggcatcgccactactgccctcccacatccagccatcatcctagaataacagccactgttgtcccctgacacttgacggcagttcatcttttatgacccccattgtccccattgtcagttgtctttttttttccttattagaacataagctccaggaaagcagatgttaacgtctttgttcactgatgtatctcaggcatttaggacagtactggtacatagtagatgctcagtaaatagttagatgaatgaatatttgctacttttcttattgacagacatttctgaggtactttaatattacgttaagtaatgttacaatttcccatgtgttgattttatgtaaataatgagtaaattactctcatagagattttagaattctaataaactcatatttccccttcttaaaagagtagaaaaatgcttttaagagttttcctaaattaatattctgggaacattaaattttagaactttactctgagggcatagataaaaataaaattaattagataccaggaatgtcagatgctaaatggtgtatggctatttgtgacattctcctagaattaaacagttattaacttgcaaagacatggcagctgaagtcagaaattgatgaacttttaaagttgggaaaaaaagagctttaaggtatcttattaaaattgtaaactgtcagtttaatcatcatagaaaccatacctgatacagtaaatcgttgctattctgctttgaatttctggattctcatgaatcagacattctatttttatgtttctcttcaataatcctaaaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaaggtaaaatatatgtaaatgccattttaatctaactttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggactacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttcccttttgtggtttcttggttctaatcctgtgggttgcttttgacgtcctctgttggggatacactgtgcatccgtatttaacaggagatcccgaactcccagcagggagctaagcacagatgtgtgcacagatgcgtgcttaggtaaggattttgtgcaaggtgacttgtaatatgaaactgtaaaacgtgctaccttagactggagagagaagggggtggtctgatgttttccacacgcctcttttaccaaaatgggtcatcttatctgtctcaggccaggcccccgggggtgcacaggaacagcacagctgcagtgaaggaggggctcctgcagccgggctggccccagagctgtgggtcgtgccctgcgtgttgctcagcgcgttctgcagttgccctggccttagtcccccatctcgctgtgatagccatgcaggtcagcaactgtgagccttcctggctcccacgctgcccccggcacctctctctgtttctgctcccagcatcctctcagcttctcttctgagccccacgcagcggttcctgctttaccagcaccacttctcctctgtcaccgagagagagcaagaggctgccgcgcctgtgccaactgcctggtgaggctccgtcgagtgatgtgcagggccttgcggtacagccctctcgaactcaccccaccagaggcctgtcggcatcactgtcagaaacaggcgttctcccctcccagcccccgtcacaagctaagcatctgtgagaacggaggctctgcttccccgaggatcctgccccagacgtgggggcagcctttgcagacagcttctgtcccactcacctcctccttggttttcactcctttatgccctcacggacctgcccaccagttcccaagccctcagggccatggcagcctccgtgagggtgtgagctgggtaaaaggaattaaggtggagtcacagctaccagtggctgattgcccgtgggtgtcaggctggccctaggtgccccattgctagttcactgtcctgggacggccccagtattgtcagcattgaaggaaagaatccggacaggcagcagaggctcccacctgatgacactgaggctcctgccttagcaccagggcctgggctcccctttgctgtaatgtcgtaaagtatgtcaggaaggtttgcccatgacctggtggagagagaagagatgtgacaaggcgactctggcttgtgtatcccgcccacaggggaagcttggaggagtcggtttgtgaaaaatcagggctctgagggcactggagctggtgctgagttctgcagcagtcaagaagtagagcagagctgaaatcctggctgctcatgggcatcacagatgcattcgccagcagctgggctcggctttgctctaacatccgcccctcctctgggagcgttgtttctctactcctggctgcccagcccagctccctggcctggcgagatctctgcatcatttcttctccccagcttctctctccacccatgccgccatgggagagtttaggctgtctcgtccctgactggcctgaggtagggctgtgactgtctccttttccctctctcctgtcttcctcacctatgcccacataatcagtccaccttccttactgctggatgcaaacctgctgagtctctatggctttcaggatggagttcaaagacatcacctcagcgtgaaaggccctttcaggtctggcccggcacaaccctgacacccgcatgttcctgggtgcaacaacatggggccccagggcagcttcccatgatgcatcagcctctgctggctcctgatgtggcctctgttcctgtcttaggcccctattcctctcggcaggctccacacttgccttactctatctcagaagctcatcctgacaccagctctgtcctctgtactgggaacatggagcagaaatccatcacggctgctgatccatgcatgctgatgagttgctggctgcctccttgtgcacagcatctgggggcactcaggtggccctgctgtctctgggcctgtccctgacactggcaggggttggggcaccagagttcaaatgggggccgcatatcttgtctaaatcttccagagttttaagtcaagccagtgcactattgatacaatatgttgtgtcttcttctttgacaactacatcttcaaaatggaaaaaatatgtggggacctatggtttttatatgaattaatgttggcaaaatatcaaagaccactgaatttaactgttaatttaactgttatctaggtgttctgttcagaggccactcatgtttgaatgagtaacaggatcaagacatgatttatcaataagtgcatatatctcccataacattgattattttgtttttatttctgcaaatgactaatcatgttttatattaagcattttcggataatgcttgttctgttggtgctcacggcctaatgcggggctagcgcacagcggcctacatcctgttttttgtgcagtgtttacagtttttaaagagttgttaaaaaataaaatagtgcaacagagacatggccacgaagtctaaagtacttactctttgcccctttacagaaaatgtttgctaccacttgatctaaaggattaaaaaataaaacatgtcattgggccagatgcggtggctcacgcctgtagtcccagcattttgggaggccaaggagggcggttcacctgaggtcgggagttcgagaccagcctgaccaacatggtgaaaccccgtctctactaaaaatacaaaagaaattagccagacgtggtggcgcacgctacttgggaggccaaggcaggagaatcgcttgaatccaggaggtggaggttgcagtgagctgagatcctgccgctgcattccagcctgggcaacagagcaaaactctgtctcagacaaacaaacaaacaaaaatgtcattgaatttgaagtatacaaaatttgaatatctttctatcaaaaatttgaattttaaggaaataacaaagcaaaaattataattttttgtgttttcaaaaaattattttttctaaattattaagttataagatataaagtagttaatgtgaaatgtttaaatcaaaattgtttaaagctgagttttaaatttaatactttgaaaatttagttaaatcatattaataattttataagaaataaaactattgataattctgatgtctgacatctgtctgattgctgacatggatcctgagtcttacagtgttttgagggcctccagctacattggggttccagtgccagagtggctggcagccccaccctaacgagaagtgaaggggctgggcatgctgtttccagtgctttcatgagatgctgctttgcctggcggtcgggcctgatgtctcgttgttccacctgtgaccaaggggtccctctggaaatgtgtgtgtactgacacatgccctggtggctcttgtctgatccatgtccaggttattcctgcctgaccgtcactcgtgccaggagcccaacacaaattcaggcacaaattcagtacaccacacaatgggggaaacatgttcaaagatttttacttacaggtcctgagcagggagggtgccatgagtcaggagggccgtcctctgtccctgggtcatgcaagcaggaacaaagggtcaggcagagagagagagcactgcagccaaccagcagaacaaataagggagtagggtggggtcacttgaagtgtgtgggcaggtgcctgagtgaaagatgcctctaggttctcatctctggtactggcttgagccactgggtgtggtgtagaactacaaagtgtcaggggtggctgaactctgccgctactaggagaaagtgcagctcatattccagatagatgctgaggcaatagaaaatgaaaagaattcactatgcttacgcagagtgtgtctggacacacacaaatttaagagtaataagaattgcttaatatggcataatttccttaggtgccatgtgcagttgtcacaagcattgcactaattggaataatgaattagaaagtggatgttggtcattattaggaaaaggtactttgttacacgagacagtaattgcattgtggcaagagaaagaatctgactaattaatttgtcttttttttcttttgcctatgagtgcttcttctgcttgactcctccccataatcggactccttccaagacagcctaatcttcagggcatttggatgcagctgccttttgttccagagacacaggccatctcaggggaggtatctccctggggcctgaacagcgtttttctagacaagaggaggctgagggctgtgggttctgctttgccagccctgaatgctggatcccgagtggcagaggcaccaagtgctgtatgatgtgtgtatgtgatgtgtgtgcatgtacatgtgtgtgatgtgtgtccctgctcgccccaggctggccatggtactgtgctagtcacagactggctgtgctgatcaagccaggcacagtggaaaatgggaagatgttggcgtttgcccctcccttggctgtgtgtcattcacctggggcatgagctgtgcccctgctctgcagtaatgaacaaggcagctcagcattggtccgagacacgtgagttaagagaggaggaagagcactctctgggggcggggggatccatttgtcagtggcctgcagtttcctgtcccagggatttcactggtgacatcctgaccactcacctgcactttatatggagctgttttcatcagctggcgtctgctgagcctctgcattgtgttgtgtggtagcctgttactttttgcagttttattttctaaactgtactcttttattgatagattttttgtattaggatttccatttaaacaggactttggtacgtctgctgtgggagatttgtttccctagaagattcacggctgtcgttctctcccctctgctcgtggtgttttactgtgactgcgctgaacggttagctgtcacatgtcattctctgggtggtgtgctctgaagtcattgtggtgtgtgggccccttcagcctagttctgcctaactgcggcatgatgaatgggcccgaggcagaggaggaggctccctcgtcggtaggggctgctgttgtcgcagctgccggcacacggaagtgagtcggtgtgctgctgccccgagtgactgagggacagaatgaggctggggccggccggactggcattggcgtgtctgcatggcgtcgtccaccactgggcctttgcacatggggacctttttcagcatcatggggcgtcggtataaaaggaggcgcaagaagcgctctgagaggaaaggtaattcatttagtttttattcttcagtgtgaagcatttgtctttaatgcaatacagaagtgttttctgggatagacggctttgtgaattaatcttgctgatgccagttacttcctattttccctttttgagtgccttttttgttgttggcattttatagaattttagataggggcacttaaaaaggaagattcaaaaacatgtctgtaaacatgaatagaaatcatttagcttcagagtctggagtatgtctttggaaagatatttataaaactttaaagtttgtagctttgagctacagaaaaggtttttctcccagagacagatgcttatatgagatttcctttgccgcactcttcattaatgacttttctacattaaaactgttcttcatgctgcagaaagcaaggctgagcaaccattgtgaaaatatttcccctttaaaagaatggagagcaaattccttacattctgcactccaggttaataccagtttttaattcaacttaatgttttaagtcattaaaatctagattttttttctcaaaaccagattcaaaagttgtccatgactatacacatcacaagctactggtttttggacctaaattgctgctttaaaagctgttgatgttttttttttctctttgtataatatgaaataattaatagaaaatgccttagtgaaaagatgtgtctagcccggagaacagctgaacacaggcgtgatcagtgcctctgcctctgtgtcttctgggcgcccccttagtgtcccccacccgacaggactggagtacagcgcttcaccaccacagggcccttgggacatgctgtggcaggagatggctgtttcttcaggaagtaaaattaacctcggttttttggtgtggcttcctaagaagaagaacagatgaatctcaaagtcagcaatcttgtaatagtaccttgtaatataacaaaggtgacagcacctaatggaagtctgtgtctgggagtggggaacccctgaccctgggccctctgtgcaccgtgctgccaggtgcttgtgtccagggctggggatgccacaccctcgatgctttcctggactgacgggcggtctcaggacagccaatctgtgcggccccctctgccctcacctcaagaggtcacagcattggcctgtttttgtttcctcagttaagctttggaaattgagatgtcactaagacaggcaatagggagtaaaacaaaggcacaggcaaaaactaaaggacatttttaccaaataccctcaatttagaattaccaccacttttcccatggacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggcccacatattaaatggcttgtgttccttggtcattcctatgtgagtaagttcattgtgagtgttactaaacagtatcatgttatgtgttagttctcgctgttggtattttgtaataagcattatctttgaaactaataaaaatacctttgaaattatcgatattattaagattggccatcacatttataccaaactggcaaagttttataagatgtaaaatagtcttttatactgtatatttctaaggtactgtaaatcatgtgtattgcatggttttttccctaagactgatacaatgtacgccttttaaaatgtaattctttgatgaaaacaatgtagtagcaagttacgggttttagttggcttcagtggcaatataatttcagtgatttttttcatcactcctgaattatacttgcagttactcccttccacagggcaaataattgactgttgactgtgtgtgagcctcagatgggttagcttaatcatcaggaaaatagggctaaagaataatgtaccatttaaatactggccagagtccccatcaagcagacactgccaccctggcagatgctgccagcacgagacctgggagaggtctgggagccacagggcaggattctgagtagcagttagtgcccatatatggagcgcttcctgcacccagccagtgctcagtggctgctgctgtagcctcattcactcacagcactgctgctaagttcatgaccagtgggaggggagagagatgggaacaaagaggcagtccttcagtccccaccctcctgctgtctgaatagcatcctgtatttccagatgtatttctcactgagtgttttgtttgtcccctatgtgataacatccttatctgtgcttagtcgtgtatgcacatgtgaagaccactgtcctctggcagcagttctgaactgtgttttagtctgaggctgggctcccccatgtttccaggatagaggtgaacagggtgtggggacctctgtggagctggaggtccaaacgtagagaggcctgctccccctgagtacttctggaggagaagccctggaactcctgaccttcacccttcacagagtgagcagagccagttggccaaggggaggaagcaggcggctgtcgtaccagcctccttctctggtgccagccatgactctcaccttacaaagagagcaaccctttgtgagatgcagagcatggtagcacctggaggtataggacgggatggcatttatccacccatccatataccagtccatctactcattgtagtccatccatctgtccgtcaacctatcatccatctgttcactcatttacccatctacccacccatccatcatccatccactcacccatccatccacccatctacccatgcatccatcatccatctctccatgcatccatcatccatctctccatctagtcatccatctatctgcgcatctacccatcacccatctattcatccatccacccacccacccacccatcatcacctatcatccatcatccattcatccatccatccacccacccacccacccatcatcacccattacccattatccatcatccatccatccatccacccacccacccatcatccattcatccaaccattcatccacccacccaccctcatcacccattacccatcatccatcatccacccacccacccatcatcccccatcatccatcatccagccatccacccacccacccaccatcacccattacccatcatccatcatccactcacccacccaccatcacccatcatccacccacccaaccacccaccatcacccatcatccattcatccatccatctacccacccacccatcatccattcatccatccatccatccacccatcatcacctatcatccatcatccattcatccatccatccatccacctacccatcatcacccatcatctgtcatccatccatccatccacccacccacccatcatcacccatcacccatcatctatccagccatccatccacccacccatcatcacccatcacccatcatccatccatccatccacccacccatcatcacccatcacccatcatccatctatccatccacccacccatcatcacccatcacccatcatccatccatccatccatccacccacccatcatcacccatcatccatcatccattcgtccatccatccacccacccatcatcacccatcatccatcatccattcatccatccacccacgcacccacccacccacccatcatcacccatcacccatcatccattcatccatccatccacccatgcacccactcatcatcatccatcatctgtcttccatccatccacccacccactcacccatcacccatcagccatcatctgtcatccattcatccatccacccccccacgcacccacttctctacattgttccgttcatccaacaagtactcattacacccttctctgcatgctggcaccaggggtttgaacatgcttagggaagatgggggtaatgggatggcagtggcagggggcagccacagctttcaggcttgaggtttgttctggaatgggccacctgaaatcccactaggtgcatgaagaggatggatttatgtgatttgtcactgctgcactgtatgtgtagtagtggggagggatattctccagtatctggtgagaaaggaagacaccattctctagcagtgtctgccaggagaggggcccaagtaaggaaagttgaacccccagtggacagcagcgttatggatagaaggcccagatctcctagaacccgttgtaatggctatgtgtgtacctttcactgcatctgtgctgatgggcctcgcagcacaagaaagactctgctgcctgggcaggagctcctctcagctacagggtgcatttcaagcacaggtgcatacactctaggttaacagttgaaattctaaagtaagcatgtagaagtagatttgtgaaattgcacttgaaataccatggaaattggatccaaagcagattgaacagtgccaattcttagtgcagttataagtgttaatattgaaaataaagtttacatcgttgtcttttttttccctttgattccagaaaattaactacaattttcaaataagcaggaacttacttaggttgtgttaagtagagcaaagtggacagtctttcaaatgcattgctgctgcgtttgcactgtgaaggacggagcaacttcacgaaggcagggccctgtgaaggtttgtgctctcgtgtgccggctctgacctgtgattttgttgctggatgtctccttcagcagttcatgtggctttctaaagcttgccattgcttaggcatgcctgactgaggcgggaaacaagcgtgtggatcagtgtggctctgtatgtgtgaacatgtatggacatatgtgcatagggtgggggtaacgagggagagggacaagaagggccagggcttgtgaccacatcagaagcaagggtgatgctctgtggcacagctggccctcgaagtcactcagggacctaggtttcttccatccttaagctctgttctctaacagaagtcaccctggcagttgcttctagtccagcaatagaaaggtgagaaagaatacagagaagcacgcaggaagctgtgtgagttggcccagatgcagtggcacacaccacaaattgcacagcacccccacaggaggcgagcctgtgtccttgcccatcacctctttccagctggtgtccagacctcggggtgatcactgattgttgtttcgttggtctggctgtggctcttcttgggccagcagcctgggagccacacagggacagggtaactgcgataaaatacaattatgcaggagaggaggcggaagggcccagcctggccctgtctggccagcttcctgcaccctgcacagcagggagcatcctcattctccagaccctgattcttctcgggttggggcgggaggggggaactcccttgtccattgttctctcagccactggcctcatcctttgggggttctttctgatcatcgcctccagagtcccatctgaagagggtatcagtgtagaacacagtgaggcagaatgtggaagcaaacgggaccatctggaagttttgctctaggccttataaaacacataatttgttaggtgtaaaatatatagtatgttgtagtagtgataataggatggaataaatgccttagatttgcaaaattgggtcagagagtttagggatctttggtcctgtaccagtgacatcattttgtggctcttggggatttggggagggacctccccgaggccactgtgcagcagcctcatgcccagggctcacaggtcccatatgtgtttcctccaccaaagcaccctgagctgtcctaccttcctcacatccccacaccccgcgggtgtccctctgcttagcagctatttattctgcctgtatttgggccaactgcacaggctgtctgagacctgacagtatgctagaatgtacagggcatacaatattttgtgtaatatcatggaaaagtgtgccgttctttcggttgacggtggttgcagataagactgcagagacagcttgtggtgggttggagtgtgactcagtctcccgtgggtctgctccccttccagactgcatgtggaattctgtatagagtaaggcatattcgtgtatgtgggagggaggcttagaataaaatttattttttttcttatggaagcagtacatgttcattgtaagaattaggaaacatagatacaaaataaactttatgaaaaagcaaaggtgatcatctgcattagtctgttttcacactgctaataaagactgaataatttataaagtaaggtttaattgactcaccgttccacatgactgcagaggcctctcaatcatgacggaagatgaaggaggaacaaagggacgtcttatatggcagccagcaaagagagaaatgagaaccaagcgaaaggggaaactccttttaaaaagtcagatctcatgagacttcttcactaccacgagaacagtatgggggaaactgcacctgtgattcaattatctcccactgggtccctcccacactcgtgggaattatgggagctacaattcaagacgagatttgggtggggacacagccaaactatatcatcatccttgaagctaaatctttgaatgggagcaaaaccataataattttcttccaattcgtagtactagaattagatttagaagtgtttaaggctttatatttttgtcttactatgaccaggggctcagtaatgccttacttctgccttggaggatgatgtgagcatacaagaggggtggccgcatccctccagcttcattcctggtgtccaatgggaggcgaataggcccctttgcacctcttaaccaccatagtcctctcccattgccagcctcttctgacttttgggattgttttaccctctggacagcagtgtgaacaaggtatgtcaggccaagggggctgctccccatgggaggcctggccgtgttggcttccaagaggccagatgggtgctgctcaccatagaaagtgacccttttccctgttcctgagccaacctgtcacttccatgcgctgtgtgtcactttgaaaactatctttgctttctgcaaaatgaaaggaaactttcaaaagtcaacgtattaaagcctgtttgcatttattcttttatgaattttgctcacattttttaattgggtgtttgtctaaagacaattatcgatcatagtaggctgctggaaggttgaccacagaaacctggttctctttcagggaggtcaccatgtctgcctccaggcccatcgggtaggggctgccttctgtcaaggcacatgctccaggtcccttagatggaaggaaaacacatggtctttatccagtggactcagggtgcaggtaactgaaggaattaacctccatcattttcacagatcctcgtagagctggaccgaaggaggtgggagatccctgccgggagccgctgcagtgggagggcttacagacgttcgcatagtctctttctgtttggttgttttaactcccattaaaaggagtggctttcagccttcttgcttactgtcttgtgatgtatgtgtgttcacatgttccatgcacatttgtaacgcttaccatgctctctgattcagctttgttcccttagagttgccccagcactgctttgccatgatgattgtggtttttaaaatacttccagttgcttacttctgtttagttatctcagtgctaaatattgttaattaattaaatataagcagcatgttctagattttatgtgtctggaattcttactaaaaatcttcctggatatgacttccagtcataacgttatggattttattgtaaacaaggtagaattttatttgccttttaatcatttcattatggtgagtgtcctccttacagagcgtgtactgaatttgggttttactccttttttgttcatttccacaagttgaactctgtgttattatcctattttctgttagggtcattgtgttgttaagtaatcgacttacatagaaggtgtgcacctagaaggttaacagaaaacaagttgaaacatgactgaaaatatatttctgtaagaattactgtaattcttctgagagtataaatagccagggttttaaagatctgctttataggatttatactgcaaataacttggcaggattaattggcctgcatttgcttgctgtagtcagtaccatctagtgttttagtcaatatcagtttttgtagtgtggatgaggctggtgatggcagctgcagcctgtctggagttgctgctgccgtggtgtcagctgcagcgggggaggctagggctctgtgctccgcaagttggtgggaaccgggaacaggtggaagccccacccccttccaagttggaggggcaggagccccgccatcctgggcacagctgcagccgtccattagaagctgtggacccaggcatccctgcactcaccggggcccaggaagcccccctgccccgacaggctgagaagtgcctgctcccactgcttggtctctccccactcccagcacctgctccagtttcagatcaaagttgtggccgagctgggacactgtcacaacctggctgggtgtgtgtttgctcagggcagtgctgacatgccagcaccctgctgcctcggcacccccagactttgggtgctgacaagcatgagagggaggccaacgcggggctgagggaagcacagcgcaggccttgcagccgcccctcggcaggaacactctggatgccatgcacactgtggatggcaggataatggtggccggaggcagacaagctcctgggaagaaaggggagggtccctggtgaaactccaccttcagcttacagagggcttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggacgacctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtgatgccccctttggggccctgcggttcctggtgtttccaagcttctgggcactaccgtattccctggtttcagccatggaagctgtgtgtggtatgcctggttcagctgcagccttgcagggagccagtgtccatgccagtgcctaggtctgcccgtctcacctgcctggctgtacacaatggctggaccccacgcccactcactcacacaccccttgccactccacacctggctcccccttggcaggcatgggatccaggctggaagtgtgagccgagcgcagcctgccaggctgtgtgggcagaatgagcccagcaggcccaagcaaaactcgggtaaaggcgccaccagtgatggaggtttctggccagaaaaatgataccctgaggatcctatgacactgggttctgatttaccaaaaagagccacacctgactagggacatggggaagcaggggcatgcaggtctgtccatgaaagccccactccttgctttagggacagtagctgatgcccatgagcgctccttcatgcaggtgctgtgctagcactgaatcaccagggcttgctccgcctatagaaccacaaccaagaagatgggagagactctcagctcacagcaccagacacttcagacccaggttggagagctcaaaggcctgaaacaggctccaagaagatgtgagtctgaattcacagcaccagacacttcagacccagatgtgaatcttaactcacagcaccagacacttcagacccaggtcggagagctcgagggcctgaaacaggctcagtcccagactctcacccagtgctcccttgcccgctcggccaactgtcgttttgcagacggcaggctggtcagaggcttcccatccagagtgacccatgaggtgtttctgttccttagaagaggacgctaatagctgcctgggaaaacagttgttaatgaggattgtactaagtagatccctttcacatcaatagtaaccagtttaaagccttttcatttacaaatatttctgatttaaggacttagaggtcagttcgtatacagtcaagtttagatgtgttttggagaaagtggatacagcccacaaggtcccaaaaggcaacagggcacaggtaacattccctggctgtgattagttggttgaggacatcacaattggaagcatccacgttcttcctcacaggaagcacttggctgagagctgtggacactgaggatgaggcttgagtctgtcctagcagagctcagggcctggtgggaaaagcagggtggtcaggccagcgggggagtgagcagggaggggcaaccagctttgcacaaggagccaggaatctcccccccacctccaccctgcaccaggggcgctgactctgggccctcaaggccccccactggggacgctgactctgggccctcaaggccagtggcatccacagctccatccacagcagcgagccttgtgcagtttcaccacaatagtagcacatgtgtgacctcctgggggctgctggggcctatgggagtcgggtgtggacggtgtgctccctgggcctgctcggggatgctgagtaccaggcagcagtgagtggggtgactgaagggaaactcgagggacatctggccctctgctctgccacgcttgtccccatgcttgctgtgtttggtttggggccattggccctgctcctgtagactcagagtagctgtctgtcccacgttgccatagctgagttcactcggcacagtcaccttgggctgtgtgctttttttgctgatcccttaactggtgagaactagtgtacatttgaacacttgccatccagttgacacctttcaataaaaattgcagattaataataaatgatagaagttcatgctttttccttctggtgaagaccaacacatggccctgttttaaagagcagaaagctgcagagccactgccacgtcgcaggcaccatccaggatgtgtaggcgtctcagggatgttacggcactcagaggattggtttatttttaggaaacaactgtagcagccaagtgaagactctggacaggggaggacagctgttgaatgtgtccacagggcctgaagtaggccacgaaagccccaagtttgcccctgcgttggcacaagtactggggctgccaaggaaaaggcgggggtggaggaactcagtgtacagcatgcctgtgggggcaggcatggcgcccggggtggaggggtggaggagaccgagcctgccccagccatgtgggcctcgcagcccactgggagaggcaggccacaaacagggagacaaattgtggattgcactgtgcgtggagggagagggagcggggcggtggggtgggttggtgccgtgtgagctgggacttgagcagtaaggtggggtctgatgaagccttgcgcgaggacatggcagggagggaacagggaagcaccccaggaagttggagaggctctggtgggcatagcgaagggctgacgatgagcacatgggcatgtgttagagcacgttttttatttataaggacataaccctggctgctgcgaggagaggggctctcagggtcaagagaaggcagagaggctcctgcacaagctgagtggtaacagcagcgcagaagcagacaggctgatgtgtttagcccaactttgggagaagagctggtgacatggggtgtggggtgagaggggagagagaaccaggtagtctccaggtgtctggcctgatggctgcagcgaggtgacaggatttacacatgtgcattggtacacctgctgcccgggatggccaggtgaacaaggagttggcctttgtcaaagctgaaaacaccttacttgaggccccctggagcgcccaggcctcaccaggcccacccccgcccagccaccctagagttgccttgctgggccagtctactactgtctgtgcgactggcatgtggttctcccgtgatgcatcccttttagtgaggaaggaactagagccacagtttgatgaagttgctgactggaccactgaggtgttagtgccctgtgcaaggtgccctaactgacacctctgcatgtttctttctgtcatttgtccttgctagaatttcctcttctgtttcagtagattcctattctcatcaatatttcccacttaatatgatgaatattgtacattattattcttattttaattatctcctttttgcattgcactagaaaaaatgtgtttgctgaaaattaggcacaaatcttgcttgctctgtgtacaagatctataaagattcacttagcagcttgcagggacggtttcctagaaggtaaaatatttcactgaaaatattatcaattgaatattttggaacactttagtgatattgtttggtttagataatactgaaagcaaaatataaattatgaggtgaagtgtatctctaaacatgcatgattcgcttgttgagtttcagattgttttcgttcaaatgatgtaagaggtttatacttcagttgcttttgttaaataagcaaatcatctttcaatttttttgctacaaagttaatctagctttggaatgctgcttgatgtatagtaaagaatgaacacgaataatctccactttaataccgtttctttttttttttttagtttgcagttcaaagctattaaatatggaacccatagcagtcataaagaatatgtaaaagttttctcaaagctatccatttttgaggggaaaatggatttaatccagtaatatatgttagtaattttaatcaagttcaccagttgtcttaaacagtttttaatctataaacttttagtggactcctaaagatgacattttttaccagcacaatagaaactattcaagttctgatgcatctttaatgtaaataagtcatgtttttaatattttattccaggatatgttttttcattaagggaaggggagaaaaagggtaggtatgctcattgtccaaagttgataagaacattatatttatatatattgtttatacttgtggttgcaatgtatctataaaaaggtataaagaataatataacaatcatttacctacccccagtacaaaacgtataacattgtcaatttgaccatgttagctgaaatcaaaagcgagctcatgaagaaatgatcaggacacggtgagggaacggccttgtttgatccagcttgatcttcttccatgtcggcacccagtgtctggtcctgtttattaaaaataaaaagcatgttcatatgtccctgatttaaaatgccacctttaccaaatattctgtgtctggatgtgttgtgtctgattctgggtttttcttccatcacattgaccctctttgtccgtgagccacgctgtgttgcgttaggcactgaggctctttatttctaataggaaggactaagccacctgctcctttggttcagagttttcctgagtatttgagtctgtttatccttttcacgtaaatgttagaatcagcttgtctagttccattaaaacaagttggatttgtacctggaaccaagtgaaactgaagtctcaggtcttctgcagtcaagttcaatgttcttccacactcaccacctcccagctctgtcttcttactgcattaggaggcattctgagaaatgaagaggttgttttgaatattgctatcaaataagtcttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagagttggcattcgtcaaaactgaaaacgttggcttctgctctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcagccttctcaggcaaaccaattattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacgtccctgtaatcccagctactcgggaggctgaggcaggcagcttgaacctgggaggtagaggttgcagtcagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctagagtagctatcccattttacatttctgccagcagtctatgagagatcccttttctccacagcctcatttcacctggggctgtcactatctttaaagcaacactatgttgaatagcccttctcggaggtgtgcagcggagttatctcacggtagttctcagctgcatttccctagtgactcgtgatcctgagcatcttttcatgagtttattttccatctgtagatcctcttcgtgtcctttgcccattttctaattggactatttgtatattttactgttgagctttgagaatttcttatatattctatttgttggatatatatttttcaaatattttctcccagtctgtagcttgttttttcatctttttaacagggacgtttgcagagaaaaagtttttaacttccagtttatcagttgtttcttttgtggattgtgcttttggtgtgaagtctaaaaactctttgcctagccctagatcctgaggattttctcctgtaactttctaaaagttttatagttttatgttttgcatgtaagcccataatctattttgagttaagttttgaataaggtaggagacctgaattgaggttcatttttttggatctctagttgccccaataaggctgtgcctcttcacgaaattgcttttgcacctttgtccaaaatcagttggacatatttgtgtggtgtattcggggttctctgtgctatcctcttgtgatctgctcgtctgccccttgccaacactgtaccgtaccgatgactgtagctttgtagtaaatgctgagatcagctagactgattgctcccactttattttttttttatggtggttacattaaagtctttctaagagaattctaacacctgtgtcatctccgtgttggcatctgttcattgtcttttttcatttagtttgatatcttctgtttctcgatgtgacaagtgattttttattggaacctgattatatgatattatgagactctaaatcttactgaagccttctgttttagctgactttctcatacaccacggtgtcagaggaagcggggatgctgtctcattactgctggatgggggataagtccaagttccccactggggctcccggatagctccctgttgtgagagggcctcatcactgctccatctggagccttcactggcagcaccggctagcgtcgtttctaccaggtggaaagagagcccagcttccccacatagtctctcatgactctgcactgtggcgtgggaagggaaggggttgttagagcctggtggaaatgaagattgtggcttgtcactcagccttgtctgacaccacccaacaaggggactctggggttgtccttacagtctggcacgggtggggcgtggttgaggttttttgtttggtgtttggctggaataaagcaattcttgtctaagaagttttctgtcttgctgggctacctctttcctggtcctttggccagagagagcagcttttgttgcagctttttgtgtgttttgtttctgccaatgcctgctgatgtttctggcttcctcagctctatgttgagaaaatgaagcaaaaggaaaatgcagggtcgcttctcaggtcctgaggccccctggcttgtcagctttctctacatctctcagtctttttatgtgtgttttatgtataatatccaggatttttagttgtatttaatgggaggaaaaaggagaagaactctgtcttcccactgaggaagttcctttgcctatttaaaaccagtttcagccaataagaacagagctatttggacaggcttattcgttgttcctccagtttatagtttgggcttctgagaagcgccttgccatcactttgcctgcataacctcagtgccctcacacaagccacctgttttcccgtcttcgtgatatgctcagccagaccccttgtctgaagctcagtttgacgagcatgtcctcattttttggcctgatccctccagccaggaggctcctgggagcacccacagcctactgagggcatctgccctgactgcaggggtcttgccctctgtgcctacatctcacctcccattctagaccttaacccaattactttttatcagtccttccataatggaaatattaaaacatatacaaatatacaattgtatcaagaactctgcatgcccgtcagccacatcagtaattaccaaccagggcccatttgttggttttgtctacactcatctatgtttttctcaccacactgaattattttgaagtaaatcctagatattgtcctttcatttgtaaatacttcagtatatgtcactaaaagagaactgccatttctacacctaaaataatttatcataattccttaatataatcagctgttcaggcagtatttacatttaagtttctcagaatctgatttaggttcttgtatctagcacaagtgctttgcacgtaatagattctcagaaaatatatcttgaaatagttaatgactataaaataataatgcttttaaaactatctggaaaactttgttgaataaaggattctaaagagaaactcatttaactttcagcaacacatttgcctgaaatatagtgagattgaaagttattaacatgatttcatgaaaaactatatatataaaatatctatttttagatatatgatatttgatatagatatataagatatatgcatgttttagtacattttagtcaccattttctaagagcaatgaatttgccttttagtgatttataagttttatttgtacacaaagtaacgtgtgattataaaatttgcaaatcttctttttcctcaattgcaatttgatgatattatttattatagaacatgtattaatacagtctgacaaagtataactaaaatatttaagaagaggaaactcttaaatttgttagtaactagaaattgtaatacctgttctttgaggatttcctgtggtttctcctgccaacaaaataatacttatatgtaactaagaaattagattgaattttagcagtcatgtgcactttagttttgtctgcataaggagctattcaaggtgagagagaagtagctaagtgagaagctgtaggttctggttctgctgtgtggctttagtttacagctggaagccaaaagtctacccagagtaaagatagatggcaagtatgtgagcgcccttctgaggtctgtcgccatctgtcatggcgtgttgtgtccttagtccatcctgcagcaggcgtctttccagagtgcaaatgccagtgcctttgtccctagttcagcgctcttcatggccctccattgcctggaatcaaacccaccctcctcagagtggtgtgaggtccctgggcactggccctgaacctcccttgctgggacctggtcccaccctcatcatccctccatgtgggagaatccacgcgagacgtcctttgctgtgctggaatccacgcgagaagtcttttgctggactggaatgtgccaaggaggagtattttgtaccagatggcagatctgacttctctaacaagacctagttcttattttatgatttttttcctttaatttgtaataatgttgtaattatttccttagagtagacttacttcatattactcctgtcataggcacactaaatgctattttcttactgtctttcagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatttcatgagaccagtgtggggattgtgttttttcccgtaacatcttctactgacagtggcatgtttttaatttttggtgtgttctctgcaacaggtgtcagaatttgctgcagacgtttttccttcctcgttatcgtcgtggggcatcactgtgccccgtggaatgggcttctgggtatatctcatgaagccccactgtttcatgtggagtcctgtcacggcatgcctctcagaataatgctctgagtattcacacatacaaatcgaagataacgtctgagattgatttaaatacccaggcctttgcaataataggacagaaatatttcccttcaaaatgcaggttctcgctgcattttgaaggaaggggattcacacgtgtctgttgatctaaagttcgcaaaggtgctaatgagagctgggactggtgtgggcctcctccttccgtgctgttctctctggtgccggggtggtggaaggccgctggggtacgttggtgtttcggtgaaggtacttatctcttctagttcatcttcagtcccagaaaacaggtttagatgcttccacggaagttgggagagtttagtagagaaattacaacaaaggcatcattgctctaactaatataaatatctgtatttaccttcttacttgtctgaaggaataacatgcagctgtcaatgatgagtgacatgtcactgggagtgattattgagcattagaacttagcactttccctttgactttacgcacaaccgatgatctggggtcttggagtcactcttgcgtaccatgtagaacccaaaccatgacccagtgaagcatttctgcatggtattgatttctgcatggtattgatttctgcgtggtattgctgccccatgggtgtgctgtggaggcggctgggcctctgctctatggactgtgtgctaagtgttggctttggttgaagtcagccatctggggtgtgagggtgagaccacctcctgcagtgctacccaggaaccacgggaccagcgtgctcacctcacttccgctgttgtgtgcgcagcccgtgcctgcctgctggtgattgtttttttcaggtttttatcctcatcaatcctgctcttgagatcttttaaaaacccagcttcatgtttttactgggcagttctactcactgtttccaagtttgtgacaagttttaagagagaggttacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaaataatgtctgtagagaaagttttaaatctcttagcctctaccacagtgtggcatcagttttcccatggattgtgtctaaaccaggtttatgctctgctgtcttggccgaatgatgacagccctggaattagagatctttaacctcaaagattggcagccaagggcgaggacttggtccctttaaacattcccatggatgaagctgatgaatattttcacaacttttcagtttgcttaacgtaatgagaatctaccattttacacatgtagtagaaatagaccctaaagccaccatatggggcactcgtaaattggtttacaattttagtaatattttggttactttaaaaaatacagatttttgaaatctagtggtagatgtctttaactttcattcacattacaaccttgcagggcactgtagccctcacccttgggctccatgtgacagctgcctagccatgatggaaaggaattatttcttcttctcctttttaaaaagcttgatgaacactttatactcctctttttaaaataaaaaattagggctgggcacggtggctcacacctgtaatcccagcactttgggaggccaaggcaggcggatcacctgaggtcaggagttccagaccagcctgaccaatgtgatgaaaccccgtctctactaaaaatacaaaaattagccgggcatggtagcccacgcctgtagtcccagctactcgggaggctgaggcaggagaatcacttgaacccgggaggtggaggttgcagtgagccgagatcgcgccactgcaccccagtctcaaaaatacatacatacatacatacatacatacatacatacatacatgtataaatccataaataaataaaatttaaaaattatgtttattttgccatgtaattttacaattctaaaattgtctgtattaattcaaaatctgaaatacctttaaaagttaggataaacaaattattctggaaattcatcaaataattgttttaaaaaagacaaaatcaccagaaagtgtatttatgaagttaggaagttgtaacctgcctacagcttcagttttgtgtcttgttcttacacacttttcctatcatggaacgatattaaggattcagacttagtcagcccccatatataatattctcatttttaaatagatactagaaataaaaccataccctcctaaacacaacaactaaaaagccataatactttacacaattacataagcagcttttaaagattggttcataaactaaatcaaataattgcatttattgattgaatattttaaacctgaaaaactaattatcttgtgaatgcatgtttttaaatagttttctcttctgagagacgctgcaatttaaaacccttagatagcatgagggtaaacaacagtgaaaggaagatgctaaaataaatatatatttatccatatattgatattaaattgtcatttcattagacttattaatgtaaggtctttctggattaatttatcatcccacattttgataaggttgaaaaagtctaggtacttcagaatattctcagaagaaaaaaaattatttaaagattttactttttaaagcaaaagcagttggtgacactaaatagaaatggtattagtcactaagcaaagtgtcagattacttgtttagttgaggctgatagttctttaactaaatgtataactcttcatgtatacatcaaggaataaaatttataagcacacatcacttaaccagttacaaagagagctaaaggaatctataaattttgcatttacaagatcctgcaacgaaggcattgtaagttactctttctgggcaccacaggttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggattactgttgactttccaccttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttcaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctctcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctggcttggctgtgcgcctgcagtgacttctgtgtggagcatgaccagagcccctggcttgggaaggctggagggacatctgttgggctccagcctggggaggggtgcaggtgggcagggctgcctcagccccctgacgccacgttcctctgggctctgtaggtgctgaacaccaggctctaggcctcatgtccagaaccactagggcatgagggcatggagctgcacttcgagtctctgccggagtggaacctgccaccttgtgtctttggagcccccaggatagccccggaatgtgacgtgttccttgtaggacccgggtggccctcccagaagcagtccttagggctttgttggtgggctctattgtctttcaacaggaaatttccaaatgtgcattctaggatgggtggaaaaccctcactctttttctagagtaacccttgaaggacgtaggtcagtcatccctgcgtgtcactgcaggtaaatggtgctgcctgggactgtgtggcatgggtttaactcttaagagcattttttttgttcttatatctgtcccccaaattaagagggaagtccttcattaaccatacaggttaatgagaccagtaatcccctcaacggggtgctgagccctggccatgtgcctcagatgtctgcgttaacaagcatcagccccagcaccagaccttcagagtgaggctctcggaactcactctgaagttaaagttcttcgcctctctttgaaagtttggagattcgcctaatcttacatgaaatggaaacttttatttcctctggcttatccctaatcttcttatgactttttcttctctgtaaactcgaatgaatcgccctttccctctggcaccctggccaattggaatgcgtcgccccttccctctggcaccctggccacgtcctgtgtttctgtcacagcctcagttcctcgcgtccgctcacccctgcattgcagatgccgctgcctgcgggtgcatggatccctgccaccaaagcctctgtccattctccacatgacttgtcttgaacactgtcctctggggctcactgatacttgctggtgcaatgataagagaaaaacatcctgacaactatcttttctactcatttcagaaatattttattaaggaccaacctggggatgctgggttttcctagtagtcatttgattttccagacaagtgtgaaattggtgggacatgagttgaaactggctcttaacacccacctcccagcagacatcatttcccaaaatgccatgggctcattatatccaagataaatcataagccataagaccatgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttctttcactggatcgcatctccaagctgcccctttctcttgcctttgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggttttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaacgatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgaggggtcacctctatcagactctgcagccctcttcactgacccacctcttgctgccctaggaaacctggctgctctgctcatgaccattgtttccttgccgtgccgtgtccagggaggaggaagcacccgaacagcagcttctattctaatgttttgtacctgtatcttctcccccttttacctctctccttactgctatcttttacattaatcaaaggtgaacaccacaacgactgaatagaatagttccctaggtaagactccctgcctcttccagcagcatgggtgagtgagctggtcatgttctttcatcgttttgttgttgttgttgttttgtttttgttgttgttgtttttaacgaccttagaagaggccgatcaccttctgggaacaccttacatcttagtgtgtatttcacctgagaccacttgctcagagccatagtttacatctgaagccaggacgctggagcacttggcactccagacagctggttcagggggctcccgctggttgagtggccttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccgttggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagtgtggttaatggtgacagtttactaatgaaaacatcacaagttaattctgttttccttcttattcctctgggtgccgttaacccctccttcctaatctcttcagtactttgatatttgatgtcaagattaattaccagaccagttagtccacctttccatagtgttgcccagctgtgttctagttgtgggcattcaagaaaagatgctattgcataccagaggaaatgacttccttgagtttagtgtctggacactaagcaatgacgatggttggctttccagaaatgtcacaaagtgagtcctcaataggaggttgtttgcgtgtatacatttgcccacttaaaaaataggtggtaagaatatgcatgaagatgagcttgaaaagtctgttggcccctgaaaagttaagtcactgagaataagagtcagacttcaggagcacagttaggcaaacattactgtgaattacagaaaatagtgtctctttttttttttttcaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaagtaagtttagtaaacaaataaggacaggaagctctttttaaaaaatattcctctattagaaaacattgcaaaacctttcattgtttctgtaatcatggaaaatctctcaaaatcataactttaattagtaacaataaggctgcatcccattcttccacaatgcttaacacacatatgcacacatacatacaataacataacatggtcataaatttcaagtctgtgtttaagaccatgtgattttgttgtatgctgtataaatagaagttcccaaactgccaggtaaagatggtaatttttattctagtcaccgtttctagaaagagctagtcatgtatccaaactccttttctttacaaagccattttttgtatgtggtctttctgttctgaagtcataaattggaagaaggaaaggttactcacatcctgatgacatatccattattgagtgacaagaactgtattaattaccctaaacatgtaaaataaatattccagttcaaacttatctttcccttgtggaaaatactagcctctgaaaatgatagactaaaatttaactatatacagctttaaatgttacttttgcaacttttttcctttcagtaacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaaggtatgagacgagattcttcaacaagccagtttctcaagaaaatgttaacagataaaaactaacctgtgttaatatcccttttcctttttttctttttatttttagacttggatgtggatctgataagagtctctataaaagcatggatttttttctttccaattaacttaattagaaaactttaatgaatgaaaaatgctgattgtaattaaccaagtaattagaatggagtgagaatattggattaaaattgtatcagtatttaaatttgggtaataaatatctctaaatcagaggtgtatgtgatcctccatatttctgaggaattctaatttgctaaatgtgtaattaaagtatttatttgcctgatatttcagaagcagataaacactagtgaaaagtgaaaccactattgtgatcatatttttttccatccttctttacatttgaggttagcacttttgttttttagtgttttgtatctacatcccttctcccaagcccttaggcattgtttattccaaatagaacgttttattacattactttccttgtttataaaagcaacaggcatactcactgtggaaaattgctaactatttttaaaatataagaacattaaaatcatccgtattcctgtaacccagaaatactcactatggatgttttaccatactttccatgggtttatttctgcatctgtctagatttattttggaaattttaaaaatatagaggaaaataacatggcaaacacccaagtatccatcacccagaattagcaaatgttagcattttgtcctatttgcttcagtgcatttttaatgatagaaataaatcatttcagttaaagtgaaaaccccatttccccaactcccttggagaccacttttgtgaattttgtttgtgttatgtccttcctactcaatttcatataatttttttttttttttttgagacagggtctcgctcttacacccaggctggagtgcagtggtgcaatcatggctcactgcagcctcgacctcctgggctcttaagcgatccttccacctcaaccttccaaggagctgggactacaggcatgtaccactatacctggctaatttttatattttttatagagatggggtttcaccatgttgcccaggctggtcttaaactcctgggctcaagcgatccacctgcctcagcctcccaaagtgctgagattacaggtgtgagccaccatacccagcctctcagcttcacatacttattttgtatgtgtattttgtatgtatggcataaacatatgcatttatatgcacagactgtattttaaatttataagctattgttagatgtgcttttcaataaatcaaatagatggtttactacctgtggggttttaactctttttctctcttagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacggtaaggggcgggggctccctgtggccacctccctgcacacaggattcatccatactgtttgccaacctcccttttccacaaccatttgaattttggccccatttcccactcaggtgttccacagtattctttgaaggactgaggttctaaacaggtgctgctgggacccccgtgaggggcagcagcaggacctagacacaggaggctccacgcttctaacattcctatccaagcgtctcagagtttaccacttatttttaacgtgggcttctgggttaaactgatgtttttaatgggctacaggccatgacatcttaaaactactggcttctcctcattagtagtagatgcaacttcagtggtcactttcatcattcagttaacattttaggtagttgatatgtgcattttaaaagtaatgcaaaccctgtcacaggcattgtgttctaagcacagagagcatccccagccattctgtgcctgggtgtgggttaggcttagaggagggctctgcaagcacacttctgtagtcagcaggcacctgggagatattcatctttcagaggcctgtatccagagcagattatagaaaacccatttcttcagatggtatcagttccagtagttctttgttttcatttttaaactaatgtttatttggaaaaaaaaagtaacataagcagatggcaaaaagcatacaatgataaagtttaaaacctccctcttcagagccctcctgtggcacccacagtgagtgggttttgactgtccatccagaagctgtcaaaattgatgcatacgcatgtgcacgtgcacatcttttcattgtttgtgtgccctttatgttgatttccttcagtgggtcttgtcaggcaacctcaagtacagggagctggattaatcacacattttgggccattgcccacagcccaggtgaccactgtgatgtgtttatttattatttgtccttccagtccacctccacacgtgcatatgtcaactttgtgtgtgtgtgatgtgggggaggggggtgtactcttgaaaaatacacaatagaattatttggagtatttgttgctaatttacagaaatgatactatgctgtaaatcctatctgattcttacattttcattcaacctatatttttggagctatttctgttgctctaaccaacagccagttcactactgacttttgcaaatcttccttcatagtcatgggccatttccttcatgatgggacacccatatttcttctaactcccttatacatgtagtcctgtatatccttcaacttatgcaaactccatcacaatattatagactttgctagagtttcttggggcatatattcaggagttatgcacatatataacttcacagaataatatcagattgcatcccagggcagtcacactagttgacacttacaccaatagtgcattaagttagcttctcccacattctgtaaactgatatcttcatagtttcaatttttatttctctttatcactaggaatgttgggcatctcttcaattacatattaactgttcatcttacaccttctttgagttgtctgttaatatcatttgttcatttgtcttttgaatctcatgcctttttcctcttgattttcagagttccttttacagttgatattgtaatccttagccctttgagaagatgcagtgtcttttgcaagtcctttcccctttgagtagtcttgcactctgttgaagatgatttgaacatatacacaagggtttattactgtgctgtctgttctattccatatgtctattctttatgccagtgtcatgctgttttgattactgtagctttgtaatatgttttgaaatgaggaagtttgaatcctccaactttattcttcttttttcaaaatccttttggctatccagggtctcctgatatttcataaagatttttggatgaagtttttcaaaaaatgccatcgttattttgatagggattatgttgactctatagattgctttggttaatatggacatcttaacaatattaagtcttctaactcatgaacatgcgatatatttccatttatttgtatcttcatttctttcagcagtgttttataatttttattttacaagccattcacccccttggttaggcttattactaagtaatttattcttttttgtgctattgaaaattgttttcttaattcccttttcagatcattcattgttagtgcatggaaatgcaactgatttttgtgtgttgattttgtatcctatgattttgctgaatgtgtttattatttaaacagttttatggaatctttagggttttctacatataaaattatgtcatctgcaaacagatataattttacttcttcctttccattttggatgccctttatttctttttcatgcctacttactgtggctagaacttctaatactgtgttaaatagaagtggcaaaagtggacatccttgcattgtacctgatcttagaggaacagttttcagtctttcaccgttgagtacagtattaactgtggtcttttcataaatgtcctttattacgttgagttagttttttttctattcctagtttgttgaatgtatttattattattaagaaagggtgttaaatcttgtcagatgctttttctgcatcaattgagatgatcatgtggcttttgcccttcattctgttaatgtaatgtattaattgattttcatatgttgaaccatccttgcattccaggagtatcataatgtataatccttttaatatgctattgaatttggtttgttgagaatttttgcatcagtagtcatcagagatactggtttgtagctttttttacccttcttcatgtctttggctttgatatcagggtactgctggcatcatagagtgagcttggaaatgttctctttagtttttttgggagtctcaggaggattggtggtaattattcttaaatgtttggtagaattctctagtgaaaacatttggtcctgggcttttttttttgagatggagtctcgctctgtcacccaggttagagtgcagtggcacaatcttggctcactgcagcctctgcctcctgggttcaagtgattctcctgcttcagcctcccgagtagctgggattacaggtgcctaccaccatgcccagctaatttttgtatttttagtagagatagagtttcaccatgttggtcaggctgatcttgaattcctgacctcaggtgattcacctgcctcggcctcccaaagtgctgggattacaggcatgagccactgcccccagccatgggcttttcttaattgggaaatttttgattactgacccaatattcttatccattaatagtttgaatgaattgtttttcatattcattattcctgctatcatttggttaccatctgcatggaatatatttttccatcctttcactttcggcctatgtatccttagatccaaaattagtctcttatagacagtacatagttgaattgttttttttttttaatccatttacccaatctgtatcttttgattggggagtttattcattgacatttaaagtaatcactgatagggaagacttactgttgccattttgctgttttctatatgcttgtagctttttgcttgtttttcccttattctcttactgccttcctttgtgtttctttcattattttttctaatgataggtgtattagtccatttccattttcattgctgataaagacatacctgagactgggcaatttacaaaagaaagaggtttaatggactaacagttccacctggctggggaggcctcacaatcatggcagaatgtgaaaggcacaattcacatggcagcagacaaaagagagctagcttgtgcagggaaactcccctttataaaatcatcacatctcatgatacttattcactatcacaagagtagcatggtaaagacctgcccctatgattcgattacctcccactgggtccctccgacaatacatgggaattgtgggagctacaattcaagatgggattttggtggggacatagctaaaccatatctataggattctcatttattttattttttccttttgtctccgtggggtacaaaatctcatttctttttgtgtatattctacaggtattttctttgtggttaccattgcaattacataagacatctttaaattatagcattctattttaacttaaacttcaattacatagtaaaactttacttctttacttccaccccttcacactttgttattgaagtcacaaattacatctttatatactgtatatccattaatatacattgtagttgtaatgtttttgtcatttaaattttatgcaccaaaattacaatagtattggttactgtatttgtccatgtgcctccctttacaggagaaccttatttttccatacagcttaatgttgctatttactgtctttctatttcaacttgaaggactcactttagcatttcttgtaaagcaggctagtggtaatgtactccctctacttttgtttatctggaaaagtcttaatttcttcttcatttttgaaggacagttttgccagatcaaatatgcttggttgacagggttgtttttttttttttttctttcagcacttaaaatatatcattccactcctttctggcttgcaaggtttctgctgagaaagccacaggtcttatgaatcctcccttgtatatgacaaatggcttttcacttgatgcttttaagattctctgtcttcactttagacagtttgattaaaatgtgtcttagtgtggttctccttggatttatctgtatttcatttctttgagcttgaacttgtatggtccatttttttccacagatttgggaaactgttagcaattatttcttcaaataagctcttagcccctttctctccctcttctccttctggtattcctagaatacttgtataagtctgcttgatagtgttccgtaagtcccttagtctcgcttcacttttcttcattcttttttctttttgctcctctgactcagtgatttcaaaaaaagacagtgacctgtcttcttttttccacctcatcaagtcttctgttgcatgcctttaatgatattttcagttcagttattgtatttttcagctccagaatgtttggctcatttttatactaatatctctttgttgatatgctcattttgttcttgctaagtttttcttattttgtttagttgtctatgttctcttctagctcattaggcatctttatgacagatattttaaattcttttttagacagctgatagatgtgcatttctttagggtcagtttctggaaatttacttttggtcctttggttgggctatgttttcctgtttcttgtatgccttgtttatttgtgtgctttgctaatatttgggcatttgaaaaaagaaccatctctcccagtctttgtgtactggctgtgtacagagaaagttcttcactaacaagctggctaaaaaatctaggacctcttatgctttttctgatttcctgcttctcctggtgtcttcctggaaaactgtagctctaatgtgctgcttgcctctgtttttagtggctcccaaactctggcaccagtctcatcaccgagtctgatgagactcaggcaagacagaaaccagccctttgggcagactccagacagccagaacatcagactaatgatccactcttttgtttccatcccaagagaagagccccagtatggaggcttcctcccacttagggggcaccttgctatttagggaaaggggaacaaacaggcatgccaaacatcgtgaaatttcctatccctttcattggaatctcttcctagttttacaatggactggatactgtagcttctcagttggtctccagagttctcacagagccattctggtctgtatattgttgttaactcagggtctctatgggggaaagagggcctgtagcttcctagactgccatcttgttgaagtcgtagtccaaacaccattgattttttaatgttaaccttatggccagcaacttaactcacttcttattctatttatactttcctggttgttcttgaatgtaccaagtcacagtctgtagatattgactgttctatatcttcttttgttataccagtgttatttttctttattcctgctgtccaggaccttggatgatatgttacagcactgtccatgttttcttcctgaatctgagagagattgtgactgaagtttctccatgatgtacagtttttcctacagggttttagtaggtagccttcatcatgctaggaaaattctgttctattcctattgtcttagagcctttttattatcatatattggtgttactttatcaaatgttttatgtgtgtctatttttaataatggtaaataattaatagatttcctgatgttgaccacctttttgcaattttgacataaaccttactttattatagtcactcattgttttaacatactgtttgatttggatgactaatattttacttaggatttttgtttataagttaaataggcctatactttttctaaactttttaattgttcttatctgattttggaatccaggttaatatagcctcataaagtgtgtttgtcttcttgttctactttctgaagtctcttctgtgagacagcagtgtatagaacccaagagtgaaaacatccagtccattatatatatatatatatttttttttttttgtagttatcttcatggtcatcctcatcattttggcaggagaccagtctagttgtaatttcaggtccttttctggttactagtttcttaaatttttgtttcttctagaacaaatttttagccttcatattattctagaaatttatctagaatttgaaggtttgaggcttctttgaaataagccagtcgattgtggcattcaggcagagaaggtggatctataattagagaatagagtagtggtagtaagagaatgagagctaaaaaagagtcagctaatgcagtcagaaagaagaatgctagaattttactatagtagagctacaataatttctgtggttatggtttcaaagagaaggtatgggaaggagtaaccaaataaggtggacatttgaaaattatgatgtattgtattttacaaagatagccccaccccaatgcctctcatctaaaatcctctccaacaatgtgaccttgccactgtaccattaagaggtgacgtctctgtcccatgcccctgaatctgagcctgtcatgtggctgctttgaataagagaatgtggtggaagtaatgcagtgctagttctggcatagccttaattggcctgacaacttccatttcttgcctcttggtggcagccaccatgtgagagttgtgactaccttgagaccaccgggctataagaagctgcccctccgtgtagagaggccctggaagatgagatgccacttgaagacagagagagggcaaggaacagtgaagcaccaaatgtgtaagaaaagagttcacctggaaaatggaagagagaagacaaaattaccaatatcggaatgggagaggtgaaattaccacagatgctacagatactaaaaggattgtgaagagaaattataaacaaggctatgccaattgacaatttagatgaaatggacatatttcctgaaagacacatactaccaaagctcacttaagaagaagtagataacttgggctatctatatgtattagagaaaatgaatttgtaatttaaagcctttcccaccaaaaatgacaacaaaagaaaaaccccaagctcagatggcttcactattgaattccaaacatttaaggaagaaatacccattttgcacaaaatattccaaaattgaagtgaaagagatacttcccaactcattctgtgaggccagcatttccctggttccaaaaccagatgaagacaccacaagaaaataaaactacatgttaaaatgtgtcatgaacatagatccaaaagttctagcaaaactttagcaaaccaaatacagcatcatgaccaagtaggggctatcccaggaattccaagctaaatgaaacatttgaaaaatcaatataattcaccatattaacaaactaaaaaagacacagaaaaggcattttgcaaaatccaacatgtgttcctcataaaaactcatagcaaaatagaaatagaaggaaaccttctcaacctgataaaggaaatctatgaaaaatctacaggtaatgtcattcttaacagggaaggactgaatgtgtttgcctaagatcaggaacaaaacaagattgtctgctctccccacttctgttcaacattgtattggaagttctagccagtgctataaggtcctaagaaatcagtggtatccatattgaaaaggaaaaagtaaaactgtctttatttgcagacatacttatctatgtaggaaatgagatggatattatacaaaactatgagaatgaatgaatgattttagcattgtggcaaaatataagatccaaaatgtaaaatacaaaatcagttatattttttacacctgcaacaagcagttgaaattgaaatgtgtaaagcaatacactgaaagctgtatattgaaaactgtaacacattgcctagagaaattaaagaactaaataaatggagagatacatcatggtcactggttggaaaactcattattgtcaagataccagttttcaccagattgatctatagactcaatgcaatcctaatcaaaatctcaacaggattttttggagaaattgacaaactgattccaaaatccatatggaaatgcaaaggacatagaataggtaaaacaactttcaaaaggaagaacaaagtaaaaggctaatactacctgatttcaagatagtaattaagaaagtatgattttggcataaagataagtatacaaacaagtgattccttattatttagagtggttttaggtttataggaaaattgagtggtagatacagaatttcccatatacccagtgccctcacgtatgcacagcctccccatcatcagcatctcccactctagtgctatattcattacaatcgaagacacatcatcatcacccaaagcccacagtttacaatggcgctcactcttgatgctgcacattgtctggctttggacaaatgtataatgacctgtatccaccatcacagtgtgagaccagagtagtttcactgccctaaaaatcctctgtactctgcctgttcaccccctctcacctcctaacctctactctgcctgttcacccctctcacctcttaacctctgtattctgcctgttcacccctctcacctcctaacctctgtactctgcctgttcacccctctcacctcctaacctctgtactctgcctgttcacccctctcacctcctaacctctggcaacagctaatcttcttaatgtctttgtagttttgccttttccagaatgtgatctagttggaatcatacagtatgtagccttttcagattggctttttacacatagtaatttacattcaagattctttgatgccttttcatggcttgatagctcattttttttaagtgctaaataatagtttggatgtgccacagtttattcattcacttcctgaaggttcattgcttccacgctttggcaattacaaataaagcagctataaatatctgtgtgcaggtttttttgtggacatgagttttcaagtcctttgggtaagtaccaaggagcacgaatgctgggtagtatggtgaggatatgttgagttttgtcagaaactgccaaactgtccttcaaagtggctgcactgttttgcattcccaccaacaatgaatgttgtcccacattgtcaccagtattcagtgttgtcagcagttctggttttgggccattctaatacacatgtagtagtatctcgttttaatttgcagattcctaatgacatatgatgtggagcatcttttcatgtgtttatttgccatctgtatatcttcttgaatgacgtgtctgttaaatttttttggccaatttttaatcaggttgttcattttcttattgttgagtttagagagttttttgtatatttggaagagttcttcatagatttatcagatatgtcttttgcaaatattttctcctagtctgtggcttgtcttttcactcccttgtctttcacagagtagaactttttaattttaataaagtctagcaaatcagttatttctgtcatagattgtgcctttgatgttacatctgaaaagtcatcaccaaacccaagatcatctagattttcttctgtgttatcttctaggaattttatagttttgcattttacatttaggttgtgacctactttgagttaatttttgtgaagggtgtaaaacctatgcctagattctttttttttttttctgcatgtttatgtccattggttctagcactgtttgtagaaaatactaccttttgtccatttcattgtctttgctcttttgtcaaagatcagttgactgtatttatgtaggtctgtttctagactttttattctgtcccattgatctatttgtgtattctttcaccaataccatgctgtcctgattactctagtatagtaagtctttaagtcaggtaatgttagtattacagcttcattatattccttcaatactgtgtttgctcttctggatttccctttttatatcagccttaggaacagttcatcaatatctacaaaataacttgttgaaatattgattgggattgtgttgaatctctatgtcaagttggacagaaccaacgctgagtcttcctagccataaatatggaatatccatttatttagttctttgatttctttctttggaattttatagttttacttatacagatcttgtacatactttgtcaaatttatacctaaatatttcagttttgggggtgttagtgtaaatgatgttgtgtttttaatttccaattctgctgttcattgctggtcacagttaatttttgaccaaggcacaaaggcaattcagtggagaaagaatagtcttttcaacagtgatgctgaaataagtggatatccctgtgcagaaaaaaaaaaagcaaaaaaaatcaagcaaccaaacaaatggacttcacttatattttgcaccttatacaaaatgaatttgtaatgggccatagacctaaatgcataaaaattctggaaacaggagataatgtttgtgacattgagttaggcaagtttttagctacactaaaaaagactttccataaaaggaaaaaaactgtcaaagtttaaaaattacttctttcaaaaagcactgtttaaacagtgagaaataaactgacaaacagggagaaaatgtttgcaaatcatatatctaataaacgattggtatccacaatccactgttactctcaaaacgcaacaaggggaaaatagtttttaaaatgggcaaaatgtttgaatggacacttcaccaaaaaaagatacacaaatgtgaaataagcacatgaaaagctggtcaacaccattagtcactgatgaaatgcaaaggagatgccacaacacatctcttggagtggctgaaattaaaaagactggccaaaccaaatgttgacagtgatatggaggaactggtactgtcatccactgtggctaggtatgtaaatagaacaatcacttttaaagacagtttgacacagccaggcacggtggctcatgcttttaattccagcactttgggccaaggcagatggatcgcttgaggtcaggagttcgaaaccagcctggccaacatgacgaaaccccatctctactaaaaatacaagtattagccaggcatggaatcccgtctactctggaggttgaggcagaagaatcactcaaacccaggaggcggaggttgcagtgagctgagattgcgccactgcactccagcttgggcatcagaataagactcaaaacaaaacaaagagagtttgacagttccttaaaaagttacagatatggccaggcgtggtggctcacgcctgtaatcccaactctttgggaggccgaggcgggtggatcacaaggtcaggagttcaaaaccagcctggccagtatggtgaaaccctgtctctactaaaaatacaaaaattagccgggcatggtggcacacacctgtagtcccagctactcaggaggctgaggcaggagtatcgcttaaacctgggaggtagaggttgtggtgagctgagatcacgccactgcgctccagcctggggaacagagcaagactctgtctcaaaaaaaaaaaaaaaaagttacagatatgcctgccatgtagcctagccatttcactcctagtggtttaccaaagagaaatgaaagcgtatgtccacgcagacttgtaaatgaatgtttgtaggactttctttgtaatagacaaaatagtcaaaaactggaagcaatccacgcagccatcaaccggtaaatagatagaacagacggtggcatatccatgcagtggagtactactgggtgaaaaaaagaacagtgatacacactacagcatagagaaatctcaaaataattacgcagagtgaaagaagccagatgaaaaagaggaattaccatacagtcccatttgtatatatctcgggagaatgcagactaagctgcagtggcagaaagcaggtcagttattgcctagtggggacagaacgagatgtaaggagacaggaggtttggggagtgaggtcacatgggtacatacaaatgtcaaaacttaccacagtgtccctttaagcgtgtgcagtttattgtatgtcagttgtaccgcagtaactccaggggaagaaatcacatgagaaaatgcttatataagtaaatgacagaaagcaccacaactatatgaattagaaaaattcaaataagttagaaggatgcaaacagtaaagttaagagcagaaattagttttgtaagcaacaaagatgtagcagtgagcagtaacaaagcctctaagatgtcagtacttagagcaggcaggttgattaaagtcaacagaaccggtgaggctgatcaagaagacagaaggcactaccaaaacgtatctggaatgaaaacacggatatccttcagggtccagcagagattgctacagtggagagtcctagacacttcagcactgataggttttaaaactgagacaaaatagaacattttctagaaaagtgtacattgctaaaagtgacttaagcatatgcagaaaattggaatagaactctgcctattaaatcacacacacacacacacacacacatacacacacacacagagaataaattaagaaaatagaaggaaggagagtctgtggagagaggggaagtggttggcccagacaacattgagtgagttctagacatcgtttgtgggatgatgatccccattttatgtaatattttccaaggatagaaaagtagggaagaattctgcagctcattgtgtggctcataactcaaaggttactacaacctttatctccacaccagacaaggacagtaaaggaaaacaaaacaacaacatgtcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagtaatcaaaagtgagtggtaattttcggcagaacagtggcacaacatacaatctgaaaagacctgcagacccatggggcagcactggtgatcaggcctgcctgtgtttaaaagaaaatgtaaactagatggaggcttgtctctctcacagaaaattaagtccaaaaataggtggcccagagaagctctggtggctccatggtctggagcctgatccctctttgtcccgcaccatctaagaggtctcttctgagttcagggtcttcataatccctagagctgacgaaatccctgagtacccagtctgaattccaggcacagggacacttcagccagctcagctcatcatccagagctcaggcacagggctccactcgctatggggcagctggggtggccgggcttacacactcagccacctggaagaggactggggctctgtcatgcaggaggaagggaagaaaggcagggctgcagccagcagtctgtgctagacgtggtgctcgcagaagacatggacaaagtagccaacgaccagtcctggagaaacaggctgtctgtgcagagaagcagcccaccatacactatccaaagcacatgctaggacagttaaggacctgagtatgcagagcagtgcctggcagttgcagggttcttcagtaaggcacagaaaaccccaattataaagaaaagtgaataaatttgactaaattaaaatttcaggaattatttactataacccacatatttggaaaagaaaagccacatattgggaagagatttctgatgtctcatgtgaccaacaaaggattcgacttggttacaggctgactcctgcacctgcatagcacagagccatccatttggaggatccttgctggggcgtggggatgtcacacacataaatgcaggagtcggggctcatggacctgaacccttcagatccaagccttttattatatagtaattagactttacctcaaggaagaaacaaacacaagctgatagaacctagcatgggtgggccaagaaatagcaaatggccagaaaagttgcccggaaagagccctggtggccaaaatgatgccagttggctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatccagaggaggaccagcagcctgtctattcagagtcggctatggcaagggggccagagcactgtgttgggcagactcaaaggcacgcacaggaagggggatggctttattgtagggaaagggggaggctttgggtatgttctgatggaggtaggggaagccaagatgggctctgcagaaggtggcctcccgtgcagctgcttgaagaacccaggggcatctctggctggtcctgggttgaaagcaggaaggaatgggcgtggggcaaccactaggaagctgtagtccttcctgaaagcctggctgactgggccgagtgctgtggaggctgtggtttgggtcagagtagttctcctgccctgtgtggtctggccgacgtctgtctgcagctcagtctctcaggccgggccctttactgaatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacaggtggctgtggacatgtagtgggtatctctaggagacgtcctgcctgcagtcttggcagagctttacttgttttatttgcatggacgctgactgtgtctgacaccctctcgctggcgctaggcgatttcatcctgatgaagtttgtcccagctgtcctttgtgaggtgcattagtggaagctggtgccacaccatttcccacccagggcctctgcagagctgtagacactcttggaattctctttcaaagcatacgttcagaattaatgactcctaacaaatgaaggtttctgcaggatcactgctttaaagtttgcccagaagacctaattcagcttaaagatgctgagtccatagaggcttctaatctgtagaagaaaggggcctgtgtttcttagaggtattgaatcatttcatgctttttctgtaagttagggaaaccttcattttcatttccattttggaaggtggaaggaatgtgtcataggaattggaggatttgtccattcgacacatatttattgatcttctgtatgtgccaggtacatattgtaagtgctgggataggtcagtaaagaaagcagacagaaacctcttcctgcactggggtaggatgggagcagagagtccaacatggatctgtaaattatgtggaagtcagaatggggttggagggcttgggcggcagggaagggagacctcaggcagcaggtaagcaaaaggcttgagtggctgggaagggaggcctccctcagaacggcttttgtacagggacctaaagtgggggcagccatggctgcctctgggattggtgttccagctggtggacctgtggacagaagctttgggcaagcagcaaggaggtccctgagggtggccagaagcttggggacaggtgcagggtgagaggtgacagggctgggggatctggccggaggactgctggcattttcttgggagccactggactgttttgtgccagggaatggcctgtgctggcccacgtgttcacaggggtcaagaggagagggcttggggcaggcaccgggttccccttaggagagggcgtcatgacacaggcaggggggcatgacttgacccatggcgtagcagtggcagtggccagaagtcaggtcctatatctcttccaaaagtggatcccaggtgatctgctgatgactgctgtgacagggatgagcagggtgagggtgaccccagagtggggactgagcagctggaggtcagtgctggggcatatccagaatgaggcgtaaacaggtgaggttggcggctgtttgtcatgtgctgcctaccccacttgccagctctgccctgctaggctcttgagggggcatggagtggccctgagacttcaggcctccaaatacaactgtgggcattgtcaggcagaggctgtgccacggagtgagtgacagaggggggatatatggaggctggttccagtctgggcgtcagcctcctccagtctcaagtcctgccacatccgcagatctaagcccgaatgtttctcatctgccctggcctccctgtccccacactgcccagtcgaccttcatttctgacctgtactgctgagcgtcttcccctgcagcgtgtgctgagcatcttcccctgcagtgcgtgccacactgtgctgagcgtctaaccctgcagcgcgtgccacactgtgctgagcatcttcccctgcagcctgtgccacactgtgctgagcgtcttcccctgcagcctgtgccacactgtgctgagcgtcttcccctgaagcgcatgccacactgtgctgagcgtctaaccctgcagcgcgtgccacactgtgctgagcatcttcccttgcagcctgtgccacactgtgctgagcgtcttcccctgcagcgtgtgccacactgctgagcgtgtaaccctgcagcgcgtgccacactgctgacgccacttcgtaaaatgcgcatgcgccagcccctcccctgagacactccatgaaattagattgggccactccagaggcctctctctgccatctgaataccgccccctccctcatcaagctcctggctgcttaggggcccctgccctgcccctctgccctggctgcccttgctgctgtcctgtgtcccctgccccccaggctgggacatgcgttcctccctcagcctcacagccccctcctttggggctaagcttcagggtcaccccaggagcattccttcaagtacatacacccctttttctttttcacagaaccccgccctttctcccaaattgattttacctcaatttatagttcttcatttgtctttttattgcattattgtttagctcctgagctgtatctccccccaggtacttcacaccctgtgtatgtagcgcccagcaaagggtgctccagacacagcaactcccaggctgagcagagcatctctgctctttgtggggctcagaaagagagaacaggcatattgtgaaggcatgtgtgtgttggagctgataatgaatacctaagttgccattggcatgcatcattggtgtcatgcatgtcagctgcacacgtgcagtcgctgtaaatccccacaccctacctgcctgtgcattcagtgccattgtcacttgcagagaacaggaaataagcagtttaatgttttgaaggacctcttgaagagctgtccttttttaagaagtatagtggtccccgcttctccgtagatgtgtctcaagacccccagtagactcctgaaactgtagatagtactgaaccctgtacgtgctggtatttttcctgtaagtaccttcctatataaagtttaatttatgattagacacagtaagaaattaacagtcactaataataaaataagagtgacttgaacacaagcacagtgatgctgtggccatcaatcttatcaccaaggcgactgctaatgggccagcggcatctgcaacgtggatggttcacatcccgggctggacagcacaagatcgcaccacactcctcagaacggcatacagttgaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcaagtatctctagagtgtgctgatttaatctctgtcttgattttgcaatgttttcatcctcatgaatgaaaaaaacaccacctgagctgctctgtggctatcaaaagaacatcagagtccttctaaagagacccaaggtgatgtttctgaggctctccgggccttgtctctagggccttttaagtgagtctctctgtaagattaatctcctttaccaatcacaaacctagccattcatagaagaattgatgggttcacacctgtcatcccaacactttgggaggccaaggcctagtggattgcttgagcccagaagttcaagaccagcctgagaaaaatggcaaaaccccatctctacaaaaaatacaaaaaaatcagccagatgaggtggggcatgcctgtggtcccagctacttgggaggctgaggtgggaggatcacctgagcccaggaggtcaaggttgcagtgagccaagattgtaccactgcactccagcctggacaacagagtgagaccctgtctttaaaagaaagaaagaaagaaagaaagaaatgaaaaatgaaaagaatgaaattatgactgggctgggcacctgtctgttttcctctcactcaggcactgtattcattcctgtctcagcagcagagactcaacagacactgaaaattatgtcagcattggctttcccagactaaccctgagccaggtctccgggacgtttacgctgtcttagagccaccagggtgtccacagcggtgagctgcctagagcctgccctgggctccctggagaggccctgttggctccgagagatggtgacaggtggaaccaggggtgccaatggcaggcagaggctgtctccctggtgtctgcacctaccctcgattcccttcattgctggttttcttttttctttttttagaatttcagtggctaacagtaaagtgaacaggagcttttgaattcaaaggtcctaacttctaagctcacctttatttaaaaggacacagttaaggtatttttatctttttaaacatataatttcactacttttttaaaagctcaaaactaaaaccataatcctaacctgaaacacgtttattttggggtgtgtgtgtgcttgtgtttgtgctgccttgttttctagtgcctggcaactagcacgcctttaatttgagaaaaagcagtgtggaattttatttgaaagcatgcctgtcagagcacatgaaggaggcagggatggggaaaaacagttgtctttaattaaattttacagttccgtaacttaaccattgtgttttaagaaaaacaaaatagataaaacttgatggtaggtaggttgaaattgtagcatcaatgtcttttgaagtattttgttgtgtattggtgtgtgaatttctcatgattcagaaaatttccctctttgctctctgtcttctgtacttgagcaaagagtgctttaattttagctgtcactcatcttttatatgcatagatacttaaaacattgcatgtggaatatgggacacataggtgatactcaaaaatagttgttaattagggccttgttgaatagcgctgtctaagcaatatctcatccgtaactaaaatctgcaaagacagaatcattttgctaaagaaattttctaagatattgaaagtagagctcatttataaaagtcagtgtatttttatcatatttcacttatgtgaaaagcatctatatctgttaaaagaccttgaaagatagtgtctgcaagatagagacttcaaagttactgatgctgctgtttatcctttcctcctcaatatcttctctggtctttttttttttttttttttttttttttttttgagacagagtcttgctctattgcccaggctggagtgcagtggcgtgatcttggctcactgcagcctccacttcccaggttcaagcaattgtcctgcctcagcctcccaagtagctgggattacaggcgtgtgccaccacagccagctaatttttgtatttttagtagagacggggtttcaccatgttgaccaggctggtcttgaattcctgacctcaggtgatctgtccacctcagcctctcaaagtgctaggattacaggcgtgagccaccgtgcctggcctccgttatctctaatcttgatagcctaaagcacattaccaaacccctcccctggtccccgctgcagggggctgtgccgagctgattcagcagcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagctttctcagactttctctcaaatgagtttcacatccagcacttgcaagtttcaggacaattccagcttcttatttatgtccattgatctcctgagtgtgagctcctcagctggcccagtttgttgtccaacgctcactaagataaaccaagaagaaggagcagggtgcccaaatgccgcatgcgatggctctggggaccttgttgacagacagcctgctccggggtttgcagacaaggcttcctatcctgctggttttcatgttgaatgttggcacgaaacgttaacaaacaaggctacatgatggggtagggtccttgtgaagagcttgcatttaggtatctctgggaggacagcacagggacccaagggggctggcagcaggcccaggtgtgtggcaggaagaaggcaggtgcctgctgagctgctatccacccgagaccatttgacattatgggcaggaagagcaagggaagctggtttaatgaggccctggctggagtgagagagaaggaacatcactgtgagagtgtggaaagtgtgtgtgtgtatgtgtgcgtgtgtgtgtgtgtgagtgcatgtgagtgtgtgcatgagtgcgtgtgtgtatgagtgtgtgtgcatgtgtgtgtgcacgctcacatgagtgtatgagagagagagtgtgtgtgtgtgtgtatgcgtattctccaggtaagagcaggcaccggggttgtgggaaagaggtgtcagtaatgtgagtttcctccttgccctggtttctaggaggagtgaacgtgccatgagtcattgtagaagagaacgaccaccaagcttggctccaagtacagaatcattcttttcatctgacaatttttctttccattttactttctgttttcctcccctttgcttttgctggaccgattaaattgtctttcccctttcttccgactggtgggaagttctaaatcttatttctattctgaccagtggttaccccaattttttaaaacaaatatgtttaaatcactttgaaaaaatgttggcatcaagaattaatatttgtaaagatccaaacttgggaaaagctgaaatattgggctcatttttattccacactcttcccatcctcatcttcctagattctgatgacatcatcttgagttttagaaactcattttatcgtgctttttttttaaaagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgggctctgccctaccccaaggacacgtcaagacctccatgccacccctccatggtcaccctttgtcacagagccagtttgagtttctttcctttctagaaggtacctccttgttttctctcctgtagcgttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgacttctgtcaccatctcaggagtgaactgttttccccgcggagcaggctccccgggagctcatgcctggcccacttccctgcaccacggccgccacacggctccgtctcttgctctagttctcctttctgggagagtgactccatttggggctcgtcatctctgttgggttttcagtggctgcatttggggttcctcatgtctgttgggttttcagttctccttttgcatactgagagaacaactttctagtgattggaactgtctagaaaagtttcctgaaaggaattgagctcccctgactggaagagttcaggttggaattggatggacactgttgttacggacacggtgataggggatctggctgaaaggattaacccacgtgatctccaggtgtcttctaaactcgagatcctacggagtgcagtttgcttgtttttaaattctctgtgcagatgactgtaatgctacagtacagttaccattacctattgtatcaatgacacttttgaaggtttttaaaaataataatagttacacttcactgactgccgtcctcaggccatctcccgggcatgcatgtgctcaagtcaggagccagattcttacatgcttccctgaatccacgccgcagccctgtgggccgggcctgccgtcacccttcacagtggaagcagccgcagccggcagacaccacgaggcttgcagctcacagccatattccactgtccctaggacaagtacagcttgaacccacatcccacctttcaccaccccaagccttgcctcccatggacgaagacagtgcacgagagtgccttggggctcccccaggagctgcttcaggaaaaggaggagctggcaggatcactgtgagcctctcagccccactcccccggctgctccccttcatctacatccagttagcatctcctgcccatgcagctctctggacatgagcccacctcactcaggaccacagctctgaggctccttccacagctggtgttctaaaaccctgaggtctcctttgagaaaggactgttatgtggccagaggtcctctgtgtaaagccctcagcacctggctggggttagtggacaaccaggacaaggcacttccgagctggcagagaaagcctgagagcagccctggggagtgggctggaagggtcaggagaacccagccatcttgctctgtacggattctaatggcttgtgtttatttctctgtcagctcaagggctgcccttaagacgatcacaatgaaaggctcaaaggtgctctgctctcagcttaaatggcaggttggttttggacccagaggggctcagaggctccctcctgtgttgcatggcctgtatcatcctcactgggggtgctgtgcacagttttccttatactgtaacttatgcccaggtcttgactctttcttatttgcagaataaaggccactttcagtcgagattgtaagtacacattttccttgatccactaatgaatgtctgatagtttctataacatgaacccataataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgcggcctgggattaactcattaccctagttccctctttgcaggctggaaagataagcatctcactcacgtcagcccccacactgcactggcctcagggactcgtagacgtatgcgcttatgaccatttaggggctttctgccccagaaaaagcgtatggttagtattggaagctcgggctattttcttttttccttgtttcctccatttttgtttcaagatgggacttgatttaacttaaaatataaaaaatattttgtactattgggatcttatatttttgttaatcatttagttttagtgaaaaatattgtaattctaaggtttaagtatcattcaacagtaatcctttattttgatgagaagtagtggaattgcaaaggaagataatataagcgttatccatttgtttatgaaagattcaattccattatggtcagagattccccagcagtttaaatggacaccctctcttctagccattcccccacaaaagaaatccttcctgattctgtctgcttgaagggtgtgaccttgaacatgctcctggggctgccgcctctacagagtgacagctcagggacctgcaggaactcagaacatgcaggcaggtgctggaggtagggcaggtgtgctggtaagatggatgacctcagttccactggcaaaactgtgccacaggagaaacctgagcgtgtggtaaaaaccaccccagcagcaatcagtaaatgcaggaacagtgacctcaggaagacatgaggctcctaccagtgcctgtgatgaggccagcccagccctgtgtgtggttagggcacacctgaccaccccgacaaccagggaaggacggtgttggagctctgagttcttggcatgaggacatgatcttggctgattgttttccttcagaccttctgcagaattgaatgcacatcaaagaaacaagcagaagaaaccatgccagctacttgtattgaataaaagtattttacttacaaacttggattatcaaacttatgaggaaaataacacaaaagagaaagatctatatgagaaaacagaacaactgaaagaaacaatttagaaaacaagagaaataagtaatgataaatcttattagtatgttatttagtaagtgctgaaatcaaatattaatttgaaggtctagaaaatattcagtattttttgagtgtgcagtgggcatggttctgggtgttgggattttgcagtgcacaggacaaacaaaacctcttcctcatggagcttttgctctgatgagggcagggggatggtgaagtcagataagtctcagataacttggaacagaaaggcagaattatgagacagtggccagggtgctgcccaaaacctacccaatcagaatctcagaggtaggattcaatgtgcttattgtttaaagcttcatatctgattctactgaacatatctgcttaagaactacaaaatatatattggctgtctctgggttttatagctttaattttctaaggtttgtgtgaatttttggaattgtccatagtgagcaaatgttatttttttaatgagaacaattttttttatttttaaattatctttagtgtcttttcacaactttattgaggtataattggcatatgataaactgcatatttaaagtatacaatttgatacattttggcctatgtttaggtctgtgcaaccatcaccacaataaagataatgagtatacttaatccacttcaaaattgtcttagtactccttcataatccctccctctccccgatccccattcccatccccagtatgtaccatctgtctatatagatgagtttgcattttctgggattttacataaatgtcatcataaggtttgcaccgttttggtctagcttatttcactcagtttaatcacttggagattgatctatgttgttgggtttatccatagttcattccttttcattgctaagtagcattgcactgggtggataaaccacaatttgtttttcccttgaaatattgatggatatttaggttgtctccagtcttttaatattataaagctgctgagaacatttctgtacaaatctttgggcgcttacttccatttctctttagtagatacctaggagtggaatggctgaatcctaagataggtgtatgttgaactttttagaaaactattaacctgttttccaaaatggttgtaccattttcacattaccaccactagtgtgcgggagttgtagttctgtcacttatatgccggcacgcagtacgagcggttgctttagaaattttagcaggtgtttagtgatattccattgtgcttttaatttgcattgctctgatgactaatgaagttgaatgccctttcacatgctgatttgccatccctgtgccttcttcaataaactgttcaaaacttatgcacatttttactgagttgtttaacatcttattactgggttttgagagttatttatattttctagatacagatcctttatcagatatatgatttgaaaaatgctttctcccaatcagtggcttgtcttttaattctcttcatagtgtcttacgcaaaccacataattttaattttgacaaaatctaatttatagaaattttctttgatggatcatgcttttgatattatgtctaagaaatatttgcctaagtcagtactacaaagatttcttcttatattcttggaaattttacagttgcagtttttacatttaagactatatttcacttgagttcatgtttgtgtagggtatgaaggatgaactgaagttcattttttggcatgtaagatatccagttgatttagcaccatttagtgaaaggttcctcatttcttcatggaattgccttgtgcccttgtcaaaaatcagctggcatgtatatatacatgtgggtctgtttctggactctgttgtttgcctttaatctctttgtctaaaggccagtattacattgtcatgattactatagttttattataagttttgaggtcaggtagagttagtcttccaactttgtactttttcaaagttgtcttggctgcttaggtcctttttgtatttccatagcaattttatagtccactcatcagttctacatccttattgcactggttaggacctccagtacaatgttgagtagaagtgatgacagcagacatccttctcttacatgtcatcttgggggaacacattcagtctttcaccattaggtatgatgttggctgtaggattttttattgttgttttttgttttagagacaaggtctcactctttcacccaggctggagtgcagtaacgtgatcatagctcattgtaacctgaaactcctgggcccaagtgatcctcctgtctcagcctcctgagtagctgggactacaggtgcatgccaccatgcctggttcatttttaaattttttatagagacaatgtcttcctatgttgcccagattggtcttgaactcctggcctcaagcaacccgcctgcctcagtctcccaaagtgctgagattataggaatgatccaccatatctggctgctgtaggttttttacagatgtctttatcagctcaagacattttttttttctatttatagcttactcagcgtttttaatcaagaatgtgtgctggattttgtctgatgctttttttctgctcttagatgactgttgtcattgcagtgacttaggcctatagtcccagctacttgggaactaaggcaggaggatcacttgagccctggagtttgaggccatcctgggcaatgtagtgagaccccatctgaaacaacaacaacaaaaaatgagatgagcatttagttcatttttcagtttgctagtggtgacgttaaaaaaaaattaaaccaactttgcatcttgggataaacgttatatggttattatgtgctattctttttatatattgttggattcagtttgctaaaatttcatttagaatttttgtatttatatttgtctgtagggatattgggctatcattttagtttaatgtctttgtcaggcataaaatgagttggggtgcatttctttctcttcagttttctggaagagtttgtttggatttggtattatttctttaaatatatggttaaattcaccagtgaaaccattgggcctgaagtttgctttgtaagaaaattctaactacaatttatttttctataatagatttagggctattcatgttatctgtttttatcttttttcttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgttcgtctctaagtgccaacttttaggttcagtgatttttgtcttttgttttatatttcaataatttttactctgattttaattatttcttttttttccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagatctttctgttgttggttttttagtttcatttaatgacttcagtccttttaaatttattagacttggttttatggaccagaatatgatctatctttataagtgttccacaaaacttgaaagaatgtgaatctgccactttggggtagagtgatctgtaaatgttgattaggccaagttgtttgattatactatttattttcttttatattcttaccgatcttctacttggtctatcagttattgagaggcaggattgaaaatctcttagttataattgtacattatctatttcttccccttttttagagtttttacttcctgtattttgtagctctgtgattagatgcataaaaatgtaggattgttggtttatcttaataaactgacctcctttaccattatatgatgaccctctttatttctggtaatagtgtttgttctgaaatttgttttgagattaatataacctcctcaactttcttttgattagtgttagcacagtgtatcttctatccctttatattaaagtactttatcttaaaaatatgtttcttatagacatatatttatatatatttatatgtttggatcttgcttctctctcccaccatggacaatctctgccttttcactgaggtacttagaccatttacatttattgtgattattgatattattaggtttaaatttcatcttgctacttattttctacgtgtttcatatgttctttgttcactttttcctcattttcttactgcttttgccttaattgggtgtgtttgatgattccattttgactccttcttgacttttgagctgtaacttttgttaatttggtggtggtttttagggtttatagtatgcattcttaccacgatctcccttcaagtgatattatactacttcacatatagtaaaagaaccttacaacaggatactttcgtttttccatccccaacctttgtggtattgttttcagacacttttgcatgtgttaaaaaaatccacatcttattattttcatcttaataattatcttttaaaggaatttaaataataagaaaaaaacctcttgtatatttatccatgtagctatcatttccagggctcttcattctttgtatagatctggatttccattttggtatcattttttcttctggctggaggacttccttttacattccttgtagcacaagtcttctgatgatgaattatttcagctttggtatgtctgggaaagtattttgctttcattttgaagtatattttgctgtacaaatatatttctgctggaatggcagggtcctttttctcctttaagcactttaaagacattgcttccctgacttgttgtttgcgttgtttccagtaagaaatgtgttgttatctttattcctctgtgtgttttttgctctgggtttgcttaagattttctcttaatactagtgttgaacaatttgttctgttgtgctttggtatatagttttattcatgtttcttgtgcttgggattcattgaaattctttaatccatgggtttgttggtttcatgaaatttggaaattttttattcatctttcttcagatatattttccgttcccccttctctctcctcaccgtcatgaaatctaattacacatatttcaccctacctaaacctgccccatatcactgattttctgttctttttttctctctttgtgtttcatttttggtagtttctgttactgtgtctttaagttcactaatcttttcttctgcggtttctattctgtggttagtcccatcaagtgtattttttatctaatacattgtagttttcctctctagaaatttggcttaggcctttttatatctttatgtctgtatcttctatatgtgaatgtcaggcacttttccattctctcaggaggctgtttcccagccttgattgagtaacatgcctactctgatcagtgctccgcaggatattcaaggacaccctctgcgtatctccagggctcactctgtctgcatgtctcttccttccggtactctgtcttatgaaatctggctgacttggtttcccttgactctcaattcaggggatctgctacactctgcctgggttccttactctgaacagtgaactgtcatctgggttttgatatctctccaagggagggataaatggtcattgaaagcaagtgagcatggtgacggggtgggggtggcctccacagggcacgaagtgagttgtactgagtcatctgagagtgcagtgtgctgcttctggccagtgggcttgacagttcagtgtctgggttcagaatatgagtctgcccatgtctaagcatgttctaaagattcatatcccaaattagttttgattttggtggcctataacatccatgtgatatgaattatcaagctcaatatataaatgcagatacatgtattcaattccgagttatgcaagtgtctttttaaaaactttcaaccctgcagaattagcctgtgattagttaagatgagatcgtttaaacacagcaagaaaataagtacaagggtacttcaaaaagttcataaagttaaaagataaaaaaatgtttaaagatataaacattatttctcaacataagctccatcaaattcaagacatttttgtaagtgctgatcctagccatttagattgtccctaaagaactgaatggtggctaggtgtggtggctcatgcctgtaatcccaacactttgggaggccgaggcgggaagatcatgaagtcaggagattgagaccatcctggccaacatggtgaaaccccatctctactaaaaatacaaaaaccagctgggcatggtggcacgcgcctgtagtcccaggtacttgggaggcagaggcaggagaatcgcttgaacccaggaggtggaggttgcagcaagccaagatcgcaccacacactccagcctggcaacaagagtgagactccgtctcgaaaaaaagaactgaatgtcttgggagtttaaccatgtcagtgcagtctttcttacattagtaactgaagaaaaattccttaagcatgccccttaaggaatttttgagattaggaaacaaaaagaagtcagaaggagccaaatgaggtggatttgcaaccaccataaggtggatggctcatgatttcctctcgaaaccctcacacacttgcccttgtttgatgagaggaataaataggcgctttgtcatggtgaaggtctctggcgaagcttccccagggggtttctgctaaagctttggctcactttcttgaaacactgtcatcataagcagatattaccatcctttggccctccacgtgaacccaacaagcaaaacgccttgagcatcccaaaaatgctgccatggcctgtgctttggccagtcagcctgtgctttgactgggccccttctgcctcttggtagcctttttttttttttttttggattatgcattttcttcaggattgtctttgtaaaagctatttttatctcctgtttgatgtttgttcttgcttcaattttagcagaagtcatgtagctctgataggagcgcttttcaaacagatgtcttaatcttcttagtgcctcaaactagatcctattcagacatgtttcagcaagttagtacaagtttattttggtgccaaaaaattttgaaatccatgaggttttttcataataagcattttccatgaactttttcaagactcttgttaagaattagggtttcctattgcatcatggatgtcacacatgcaaagccacgtgacctgaacatgcctggcctctcagtggcaggggagcacatgcaggcatgagcgccagaggtggtgtgatacaggagcaacccccacctgcacgacctcatgggaccctgcattagtctcagaagtggctcccacccatccactctcaggctgccaaggttcctggctccgtcagtgccagagtgagaaaagacacacttgtcaggaagtctcatgatttcaggtttctgtcaatcttctgcccacctgccctgtcagacaagtgcatacccgtgggtcagttctgctttctcagcactgctcctattctggtggccgtggaagagtgtgaggccactgccacggcagatgcacgctcaagtctgcgtatattcctcggcaggcagaattcccccaccacgcacttctgtggccatgtctgagcacagtgtgccgcccgtggctgctccctccctgggggtgaaagcgggcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcgtcatgtcatcatgcacagcttccgaaaacgatcacttggaatgattcttccttcagattgttttagcttagaagtgtggctacgtccctgaaaccttaatgccatctcaaaggcagctcttttcctccctgctgcagggtaacacccactgccaggccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaaaccttttgaattagctgtggggcccttttttccccagaataaaactttatatagtaagtcagggtattactagtttgtgtgtattcttcagtcaagtagatggcatctgtttattctgagaccagcattgtgcactggcatgggaggtatagccagaagggacagtgcccgggagggtcctgttcaccaggggcagcacccaggccagctgccacaagtccaaggtccacacagaaggagttactggccgcatgagggaaggcctccgaggtcatcagggtgatgacacacataacatccgtggtgcttcttagagttaaaaatgaaacgtgaatccactattggtggtttcccagaagcatgtcttcagaactcgggggtctgtagctgcctgtttgaccagcaagactggaacttggcaataactcagcccttaggagacgccgcaccttgttctgtgtgaagccgttcccttggcagaaggcgccttcctctgggttgctttccccccagaagccaatgcagttctgaaggccatgttttggtatcttattaggtgttgttttcatctgttacagcgtcaacagttgcatttgtttttttatcccttcacaggttccctcccacttactacgctccaagattaccaaacccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcacgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctattcccaagccgtccaggcaggaggaaggcagccaaggcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14515 - DNA, 152393 bp, Human; identical to SEQ ID NO: 14514
  misc_feature (1)...(152393): n = A,T,C or G
